US009683235B2

(12) United States Patent
Freier

(10) Patent No.: US 9,683,235 B2
(45) Date of Patent: Jun. 20, 2017

(54) COMPOSITIONS FOR MODULATING TAU EXPRESSION

(71) Applicant: Ionis Pharmaceuticals, Inc., Carlsbad, CA (US)

(72) Inventor: Susan M. Freier, San Diego, CA (US)

(73) Assignee: Ionis Pharmaceuticals, Inc., Calrsbad, CA (US)

( * ) Notice: Subject to any disclaimer, the term of this patent is extended or adjusted under 35 U.S.C. 154(b) by 0 days.

(21) Appl. No.: 14/906,047

(22) PCT Filed: Jul. 21, 2014

(86) PCT No.: PCT/US2014/047486
§ 371 (c)(1),
(2) Date: Jan. 19, 2016

(87) PCT Pub. No.: WO2015/010135
PCT Pub. Date: Jan. 22, 2015

(65) Prior Publication Data
US 2016/0145617 A1 May 26, 2016

Related U.S. Application Data

(60) Provisional application No. 62/014,486, filed on Jun. 19, 2014, provisional application No. 61/885,371, filed on Oct. 1, 2013, provisional application No. 61/879,621, filed on Sep. 18, 2013, provisional application No. 61/856,551, filed on Jul. 19, 2013.

(51) Int. Cl.
*A61K 31/70* (2006.01)
*C07H 21/02* (2006.01)
*C07H 21/04* (2006.01)
*C12N 15/113* (2010.01)
*A61K 31/711* (2006.01)
*C12N 5/00* (2006.01)

(52) U.S. Cl.
CPC .......... *C12N 15/113* (2013.01); *A61K 31/711* (2013.01); *C07H 21/02* (2013.01); *C12N 2310/11* (2013.01); *C12N 2310/315* (2013.01); *C12N 2310/3341* (2013.01); *C12N 2310/341* (2013.01); *C12N 2310/345* (2013.01); *C12N 2310/346* (2013.01)

(58) Field of Classification Search
None
See application file for complete search history.

(56) References Cited

U.S. PATENT DOCUMENTS

| | | |
|---|---|---|
| 3,687,808 A | 8/1972 | Merigan et al. |
| 4,845,205 A | 7/1989 | Huynh Dinh et al. |
| 4,880,635 A | 11/1989 | Janoff et al. |
| 4,906,477 A | 3/1990 | Kurono et al. |
| 4,911,928 A | 3/1990 | Wallach |
| 4,917,951 A | 4/1990 | Wallach |
| 4,920,016 A | 4/1990 | Allen et al. |
| 4,921,757 A | 5/1990 | Wheatley et al. |
| 5,034,506 A | 7/1991 | Summerton et al. |
| 5,130,302 A | 7/1992 | Spielvogel et al. |
| 5,134,066 A | 7/1992 | Rogers et al. |
| 5,149,797 A | 9/1992 | Pederson et al. |
| 5,166,315 A | 11/1992 | Summerton et al. |
| 5,175,273 A | 12/1992 | Bischofberger et al. |
| 5,185,444 A | 2/1993 | Summerton et al. |
| 5,367,066 A | 11/1994 | Urdea et al. |
| 5,432,272 A | 7/1995 | Benner |
| 5,457,187 A | 10/1995 | Gmelner et al. |
| 5,459,255 A | 10/1995 | Cook et al. |
| 5,484,908 A | 1/1996 | Froehler et al. |
| 5,502,177 A | 3/1996 | Matteucci et al. |
| 5,525,711 A | 6/1996 | Hawkins et al. |
| 5,552,540 A | 9/1996 | Haralambidis |
| 5,587,469 A | 12/1996 | Cook et al. |
| 5,594,121 A | 1/1997 | Froehler et al. |
| 5,596,091 A | 1/1997 | Switzer |
| 5,614,617 A | 3/1997 | Cook et al. |
| 5,645,985 A | 7/1997 | Froehler et al. |
| 5,681,941 A | 10/1997 | Cook et al. |
| 5,698,685 A | 12/1997 | Summerton et al. |
| 5,750,692 A | 5/1998 | Cook et al. |
| 5,763,588 A | 6/1998 | Matteucci et al. |
| 5,801,154 A | 9/1998 | Baracchini et al. |
| 5,830,653 A | 11/1998 | Froehler et al. |
| 5,837,853 A | 11/1998 | Takashima et al. |
| 6,005,096 A | 12/1999 | Matteucci et al. |

(Continued)

FOREIGN PATENT DOCUMENTS

CN 1696294 11/2005
WO WO 98/39352 9/1998
(Continued)

OTHER PUBLICATIONS

Agrawal et al, "Site-specific excision from RNA by Rnase H and mixed-phosphate-backbone oligodeoxynucleotides" Proc. Nat'l Academy of Science (1990) 87:1401-1405.
Albaek et al., "Analogues of a Locked Nucleic Acid with Three-Carbon 2',4'-Linkages: Synthesis by Ring-Closing Metathesis and Influence of Nucleic Acid Duplex Stability" Journal of Organic Chemistry (2006) 71:7731-7740.
Allshire, "RNAi and Heterochromatin—a Hushed-Up Affair" Science (2002) 297: 1818-1819.
Altmann et al., "Second Generation Antisense Oligonucleotides—Inhibition of PKC-a and c-RAF Kinase Expression by Chimeric Oligonucleotides Incorporating 6'-Substituted Carbocyclic Nucleosides and 2'-O-Ethylene Glycol Substituted Ribonucleosides" Nucleosides Nucleotides (1997) 16: 917-926.

(Continued)

*Primary Examiner* — Sean McGarry
(74) *Attorney, Agent, or Firm* — Ionis Pharmaceuticals, Inc. Patent Dept.

(57) ABSTRACT

Disclosed herein are antisense compounds and methods for decreasing Tau mRNA and protein expression. Such methods, compounds, and compositions are useful to treat, prevent, or ameliorate Tau-associated diseases, disorders, and conditions.

47 Claims, No Drawings

(56) References Cited

U.S. PATENT DOCUMENTS

| | | |
|---|---|---|
| 6,268,490 B1 | 7/2001 | Imanishi et al. |
| 6,525,191 B1 | 2/2003 | Ramasamy |
| 6,582,908 B2 | 6/2003 | Fodor et al. |
| 6,670,461 B1 | 12/2003 | Wengel et al. |
| 6,673,661 B1 | 1/2004 | Liu et al. |
| 6,770,748 B2 | 8/2004 | Imanishi et al. |
| 6,794,499 B2 | 9/2004 | Wengel et al. |
| 7,034,133 B2 | 4/2006 | Wengel et al. |
| 7,053,207 B2 | 5/2006 | Wengel |
| 7,084,125 B2 | 8/2006 | Wengel |
| 7,217,805 B2 | 5/2007 | Imanishi et al. |
| 7,314,923 B2 | 1/2008 | Kaneko et al. |
| 7,399,845 B2 | 7/2008 | Seth et al. |
| 7,427,672 B2 | 9/2008 | Imanishi et al. |
| 7,547,684 B2 | 6/2009 | Seth et al. |
| 7,569,575 B2 | 8/2009 | Sorensen et al. |
| 7,696,345 B2 | 4/2010 | Allerson et al. |
| 7,741,457 B2 | 6/2010 | Seth et al. |
| 7,858,747 B2 | 12/2010 | Woldike et al. |
| 8,178,503 B2 | 5/2012 | Rigoutsos et al. |
| 8,329,890 B2 | 12/2012 | Davidson et al. |
| 2001/0053519 A1 | 12/2001 | Fodor et al. |
| 2002/0018995 A1 | 2/2002 | Ghetti et al. |
| 2003/0228597 A1 | 12/2003 | Cowsert et al. |
| 2004/0054156 A1 | 3/2004 | Draper et al. |
| 2004/0171570 A1 | 9/2004 | Allerson et al. |
| 2004/0241651 A1 | 12/2004 | Olek et al. |
| 2005/0130923 A1 | 6/2005 | Bhat et al. |
| 2005/0153336 A1 | 7/2005 | Bennett et al. |
| 2005/0244851 A1 | 11/2005 | Blume et al. |
| 2005/0255487 A1 | 11/2005 | Khvorova et al. |
| 2006/0216722 A1 | 9/2006 | Betsholtz et al. |
| 2007/0031844 A1 | 2/2007 | Khvorova et al. |
| 2007/0203333 A1 | 8/2007 | McSwiggen et al. |
| 2007/0287831 A1 | 12/2007 | Seth et al. |
| 2008/0003570 A1 | 1/2008 | Rogers et al. |
| 2008/0039618 A1 | 2/2008 | Allerson et al. |
| 2008/0249058 A1 | 10/2008 | Roberson et al. |
| 2008/0318210 A1 | 12/2008 | Bentwich |
| 2009/0012281 A1 | 1/2009 | Swayze et al. |
| 2009/0162365 A1* | 6/2009 | Feinstein ............ A61K 31/70 424/139.1 |
| 2009/0176725 A1 | 7/2009 | Morrissey et al. |
| 2009/0176728 A1 | 7/2009 | Yague et al. |
| 2011/0054005 A1 | 3/2011 | Naito et al. |
| 2011/0150897 A1 | 6/2011 | Meyer et al. |
| 2011/0244561 A1 | 10/2011 | Davidson et al. |
| 2011/0263687 A1 | 10/2011 | Mattick et al. |
| 2013/0046007 A1 | 2/2013 | Bennett et al. |
| 2013/0123133 A1 | 5/2013 | Ward et al. |
| 2015/0275205 A1 | 10/2015 | DeVos et al. |
| 2016/0032285 A1 | 2/2016 | Rigo et al. |

FOREIGN PATENT DOCUMENTS

| | | |
|---|---|---|
| WO | WO 99/14226 | 3/1999 |
| WO | WO 99/62548 | 12/1999 |
| WO | WO 00/63364 | 10/2000 |
| WO | WO 01/32703 | 5/2001 |
| WO | WO 01/72765 | 10/2001 |
| WO | WO 02/081494 | 10/2002 |
| WO | WO 03/004602 | 1/2003 |
| WO | WO 2004/017072 | 2/2004 |
| WO | WO 2004/035765 | 4/2004 |
| WO | WO 2004/058940 | 7/2004 |
| WO | WO 2004/106356 | 12/2004 |
| WO | WO 2005/017143 | 2/2005 |
| WO | WO 2005/021570 | 3/2005 |
| WO | WO 2005/040180 | 5/2005 |
| WO | WO 2006/047673 | 5/2006 |
| WO | WO 2007/027775 | 3/2007 |
| WO | WO 2007/107789 | 9/2007 |
| WO | WO 2007/134181 | 11/2007 |
| WO | WO 2008/101157 | 8/2008 |
| WO | WO 2008/131807 | 11/2008 |
| WO | WO 2008/150729 | 12/2008 |
| WO | WO 2008/154401 | 12/2008 |
| WO | WO 2009/006478 | 1/2009 |
| WO | WO 2009/067647 | 5/2009 |
| WO | WO 2009/100320 | 8/2009 |
| WO | WO 2010/036698 | 4/2010 |
| WO | WO 2010/148249 | 12/2010 |
| WO | WO 2011/017521 | 5/2011 |
| WO | WO 2011/131693 | 10/2011 |
| WO | WO 2011/139702 | 11/2011 |
| WO | WO 2013/148260 | 10/2013 |
| WO | WO 2013/148283 | 10/2013 |
| WO | WO 2013/173647 | 11/2013 |
| WO | WO 2014/114937 | 7/2014 |
| WO | WO 2014/153236 | 9/2014 |
| WO | WO 2015/010135 | 1/2015 |
| WO | WO 2016/019063 | 2/2016 |
| WO | WO 2016/151523 | 9/2016 |

OTHER PUBLICATIONS

Altmann et al., "Second Generation of Antisense Oligonucleotides: From Nuclease Resistance to Biological Efficacy in Animals" Chimia (1996) 50: 168-176.

Altmann et al., "Second-generation antisense oligonucleotides: structure-activity relationships and the design of improved signal-transduction inhibitors." Biochem. Soc. Trans. (1996) 24: 630-637.

Altschul et al., "Basic Local Alignment Search Tool" Journal of Mol. Biology (1990) 215:403-410.

Andorper et al., "Hyperphosphorylation and aggregation of tau in mice expressing normal human tau isoforms" Journal of Neurochemistry (2003) 86: 582-590.

Australian Patent Examination Report for Application No. 2013202595 dated Jul. 4, 2014 (15 pages).

Badiola et al, "Tau phosphorylation and aggregation as a therapeutic target in tauopathies" CNS Neurol Discord Drug Targets (2010) 9(6):727-740.

Baker et al., "2'-O-(2-Methoxy)ethyl-modified Anti-intercellular Adhesion Molecule 1 (ICAM-1) Oligonucleotides Selectively Increase the ICAM-1 mRNA Level and Inhibit Formation of the ICAM-1 Translation Initiation Complex in Human Umbilical Vein Endothelial Cells" Journal of Biol. Chem., (1997) 272: 11944-12000.

Baker et al., "Effects of oligo sequence and chemistry on the efficiency of oligodeoxyribonucleotide-mediated mRNA cleavage" (1990) 18(12):3537-3543.

Bevins et al., "Object recognition in rats and mice: a one-trial non-matching-to-sample learning task to study 'recognition memory'" Nature Protocols (2006) 1: 1306-1311.

Bi et al., Tau-Targeted Immunization Impedes Progression fo Neurofibrillary Histopathology in Aged P301L Tau Transgenic Mice Plos ONE (2011) 6(12):e26860.

Boiziau et al., "Antisense 2'-O-alkyl oligoribonucleotides are efficient inhibitors of reverse transcription" Nucleic Acids Research, (1995) 23(1):64-71.

Braasch et al., "Locked nucleic acid (LNA): fine-tuning the recognition of DNA and RNA" Chem. Biol. (2001) 8:1-7.

Braasch et al., "Novel antisense and peptide nucleic acid strategies for controlling gene expression" Biochemistry (2002) 41(14):4503-4510.

Branch et al., "A good antisense molecule is hard to find," TIBS (1998) 23:45-50.

Caceres et al., "Inhibition of neurite polarity by tau antisense oligonucleotides in primary cerebellar neurons" Nature (1990) 343:461-463.

Caceres et al., "The Effect of Tau antisense Oligonucleotides on Neurite Formation of Cultured Cerebellar Macroneurons" J. Neuroscience (1991) 11(6):1515-1523.

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Craig et al., "Towards a small molecule inhibitor of tau exon 10 splicing: Identification of compounds that stabilise the 5'-splice site

(56) References Cited

OTHER PUBLICATIONS stem-loop" Alzheimer's & Dementia: The Journal of the Alzheimer's Association (2012) 8(4): p. 636.

Crooke et al., "Basic Principles of Antisense Therapeutics" Antisense Research and Application (1998) Chapter 1:1-50.

Crooke et al., "Pharmacokinetic Properties of Several Novel Oligonucleotide Analogs in mice" J. Pharmacol. Exp. Ther. (1996) 277(2):923-937.

Davies et al., (2003) "Hyperphosphorylation and aggregation of tau in mice expressing normal human tau isoforms" Journal of Neurochemistry 86:582-590.

Dawson et al., "The tau N279K exon 10 splicing mutation recapitulates frontotemporal dementia and parkinsonism linked to chromosome 17 tauopathy in a mouse model." (2007) 27(34):9155-9168.

Dawson, "Tau Exon 10 Splicing Tauopathy", presentation given at CurePSP 2010 International Research Symposium, Nov. 18, 2010, San Diego, CA.

Dawson, "The Effects of the CBD-Associated Tau Gene H1 Haplotype on Tau Expression," Abstract presented at CurePSP 2010 International Research Symposium, Nov. 18, 2010, San Diego, CA (retrieved online Jan. 13, 2016).

Deacon, "Assessing nest building in mice" Nat. Protocol. (2006) 1:1117-1119.

Devos et al., "Antisense oligonucleotides: treating neurodegeneration at the level of RNA" Neurotherapeutics (2013) 10(3): 486-497.

Devos et al., "Antisense Reduction of Human Tau in the CNS of P301S mice both Prevents and Reverses Hyperphosphorylated Tau Deposition" abstract presented at Keystone Symposium: Long Noncoding RNAs: Marching toward Mechanism, Feb. 27-Mar. 4, 2014, Santa Fe, NM.

Devos et al., "Antisense Reduction of Tau in Adult Mice Protects against Seizures" J. Neuroscience (2013) 33(31): 12887-12897.

Devos et al., "Antisense Reduction of the Human Tau Transgene in the CNS of P301S mice Robustly Decreases Tau Deposition" abstract presented at Keystone Symposia: New Frontiers in Neurodegenerative Disease Research, Feb. 3-8, 2013, Santa Fe, NM.

Devos et al., "Reducing Human Tau in the CNS of P301S mice Dramatically Reverses Tau Pathology" abstract presented at 14th International Conference on Alzheimer's Drug Discovery, Sep. 9-10, 2013, Jersey City, NJ.

Devos et al., "Using antisense oligonucleotides to knockdown endogenous brain tau in vivo" Alzheimer's & Dementia: The Journal of the Alzheimer's Association (2012) 8(4): p. 205.

Devos et al., "Using antisense oligonucleotides to knockdown endogenous brain tau in vivo" poster presentation at AAIC 2012; Jul. 14-19, 2012.

Donahue et al., "Stabilization of the Tau Exon 10 Stem Loop Alters Pre-mRNA Splicing" J. Biol. Chem. (2006) 281(33):23302-23306.

Duff et al.,"Characterization of Pathology in Transgenic Mice Over-Expressing Human Genomic and cDNA Tau Transgenes" Neurobiology of Disease (2000) 7:87-98.

Elayadi et al., "Application of PNA and LNA oligomers to chemotherapy" Curr. Opinion Invens. Drugs (2001) 2:558-561.

Englisch et al., "Chemically Modified Oligonucleotides as Probes and Inhibitors" Angewandte Chemie, International Edition (1991) 30(6): 613-629.

European Examination Report for Application No. 13770075.3 dated Oct. 2, 2015.

Freier et al., "The ups and downs of nucleic acid duplex stability: structure-stability studies on chemically-modified DNA:RNA duplexes" Nucleic Acids Research (1997) 25(22):4429-4443.

Frieden et al., "Expanding the design horizon of antisense oligonucleotides with alpha-L-LNA" Nucleic Acids Research (2003) 31(21):6365-6372.

Frost et al., "Retinal Screening for Early Detection of Alzheimer's Disease" Digital Telerential Screening, K. Yogesan eds., 2012, 91-100.

Furdon et al., "RNase H cleavage of RNA hybridized to oligonucleotides containing methylphosphonate, phosphorothioate and phosphodiester bonds" Nucleic Acids Res. (1989) 17(22): 9193-9204.

Gautschi et al., "Activity of a Novel bcl-2/bcl-xL-Bispecific Antisense Oligonucleotide Against Tumors of Diverse Histologic Origins" J. Natl. Cancer Inst. (2001) 93:463-471.

Goedert et al., "Cloning and Sequencing of the cDNA Encoding a Core Protein of the Paired Helical Filament of Alzheimers Disease: Identification as the Microtubule-Associated Protein Tau" PNAS (1988) 85(11):4051-4055.

Goedert et al., "Monoclonal antibody AT8 recognises tau protein phosphorylated at both serine 202 and threonine 205." Neurosci. Lett. (1995) 189(3): 167-169.

Gupta et al., "Retinal tau pathology in human glaucomas" Can. J. Ophtalmol. (2008) 43: 53-60.

Hall et al., "Establishment and Maintenance of a Heterochromatin Domain" Science (2002) 297: 2232-2237.

Hatta et al., "Mechanisms of the inhibition of reverse transcription by unmodified and modified antisense oligonucleotides" FEBS Lett. (1993) 330(2): 161-164.

Ho et al., "Review: Tauopathy in the retina and optic nerve: does it shadow pathological changes in the brain?" Molecular Vision (2012) 18: 2700-2710.

International Search Report for application PCT/US2013/31500 dated Jun. 5, 2013 (12 pages).

International Search Report for application PCT/US2014/029752 dated Sep. 18, 2014.

Jenuwein, "Molecular biology. An RNA-guided pathway for the epigenome." Science (2002) 297(5590): 2215-2218.

Jiang et al., "Aberrant Splicing of tau Pre-mRNA Caused by Intronic Mutations Associated with the Inherited Dementia Frontotemporal Dementia with Parkinsonsism Linked to Chromosome 17" Mol. Cell Biol. (2000) 20(11):4036-4048.

Jones et al., "RNA Quantitation by Fluorescence-Based Solution Assay: RiboGreen Reagent Characterization" Analytical Biochemistry (1998) 265: 368-374.

Jones et al., "Targeting hypelphosphorylated tau with sodium selenate suppresses seizures in rodent models" Neurobiology of Disease (2012) 45:897-901.

Kabanov et al., "A new class of antivirals: antisense oligonucleotides combined with a hydrophobic substituent effectively inhibit influenza virus reproduction and synthesis of virus-specific proteins in MDCK cells" FEBS Lett. (1990) 259:327-330.

Kalbfuss, B. et al., "Correction of Alternative Splicing of Tau in Frontotemporal Dementia and Parkinsonism Linked to Chromosome 17," Journal of Biological Chemistry, (2001) 276:42986-42993.

Koshkin et al., "LNA (locked nucleic acids): Synthesis of the adenine, cytosine, guanine, 5-methylcytosine, thymine and uracil bicyclonucleoside monomers, oligomerisation, and unprecedented nucleic acid recognition" Tetrahedron (1998) 54:3607-3630.

Kroschwitz, The Concise Encyclopedia of Polymer Science and Engineering, John Wiley & Sons, 1990, 858-859.

Kumar et al., "The First Analogues of LNA (Locked Nucleic Acids): Phosphorothioate-LNA and 2'-Thio-LNA" Bioorg. Med. Chem. Letters (1998) 8:2219-2222.

Letsinger et al., "Cholesteryl-conjugated oligonucleotides: Synthesis, properties, and activity as inhibitors of replication of human immunodeficiency virus in cell culture" PNAS (1989) 86:6553-6556.

Leumann et al., "DNA Analogues: From Supramolecular Principles to Biological Properties" Bioorganic & Medicinal Chemistry (2002) 10:841-854.

Maher et al., "Comparative hybrid arrest by tandem antisense oligodeoxyribonucleotides or oligodeoxyribonucleoside methylphosphonates in a cell-free system" Nuc. Acid. Res. (1988) 16:3341-3358.

Manoharan et al., "Chemical Modifications to Improve Uptake and Bioavailability of Antisense Oligonucleotides" Ann N.Y. Acad. Sci. (1992) 660:306.

(56) References Cited

OTHER PUBLICATIONS

Manoharan et al., "Cholic Acid-Oligonucleotide Conjugates for Antisense Applications" Bioorg. Med. Chem. Letters (1994) 4:1053-1060.

Manoharan et al., "Introduction of a Lipophilic Thioether Tether in the Minor Groove of Nucleic Acids for Antisense Applications" Bioorg. Med. Chem. Letters (1993) 3(12):2765-2770.

Manoharan et al., "Lipidic Nucleic Acids" Tetrahedron Lett. (1995) 36(21):3651-3654.

Martin, "Ein neuer Zugang zu 2'-O-Alkylribonucleosiden and Eigenschaften deren Oligonucleotide" Helv. Chim. Acta (1995) 78: 486-504.

Mishra et al., "Improved leishmanicidal effect of phosphorotioate antisense oligonucleotides by LDL-mediated delivery" Biochim. Biophys. Acta (1995) 1264:229-237.

Morita et al., "Synthesis and Properties of 2'-O,4'-C-Ethylene-Bridged Nucleic Acids (ENA) as Effective Antisense Oligonucleotides" Bioorganic Medicinal Chemistry (2003) 11: 2211-2226.

New England Biolabs 1998/99 Catalog (cover page and pp. 121 and 284).

Oberhauser et al., "Effective incorporation of 2'-O-methyl-oligoribonucleotides into liposomes and enhanced cell association through modifications with thiocholesterol" Nucl. Acids Res. (1992) 20(3):533-538.

Orum et al., "Locked nucleic acids: A promising molecular family for gene-function analysis and antisense drug development" Current Opinion of Mol. Ther. (2001) 3:239-243.

Pal-Bhadra et al., "Heterochromatic silencing and HP1 localization in Drosophila are dependent on the RNAi machinery." Science (2004) 303(5658): 669-672.

Peacey et al., "Targeting a pre-mRNA structure with bipartite antisense molecules modulates tau alternative splicing" Nucleic Acids Research (2012) 40(19):9836-9849.

Pizzi et al., "Antisense Strategy Unravels Tau Proteins as Molecular Risk Factors for Glutamate-Induced Neurodegeneration" Cellular and Molecular Neurobiology (1994) 14(5):569-578.

Reynolds et al., "Rational siRNA design for RNA interference" Nature Biotechnology (2004) 22(3):326-330.

Rodriguez-Martin et al., "Reprogramming of tau alternative splicing by spliceosome-mediated RNA trans-splicing: implications for tauopathies." Proc Natl Acad Sci USA (2005) 102(43): 15659-15664.

Saison-Behmoaras et al., "Short modified antisense oligonucleotides directed against Ha-ras point mutation induce selective cleavage of the mRNA and inhibit T24 cells proliferation" EMBO J. (1991) 10(5):1111-1118.

Sanghvi et al., "Heterocyclic Base Modifications in Nucleic Acids and Their Applications in Antisense Oligonucleotides" Antisense Research and Applications (1993) pp. 273-288.

Sapir et al., "Tau's role in the developing brain: implications for intellectual disability" Human Molecular Genetics (2012) 21(8):1681-1692.

Schoch et al., "Antisense oligonucleotide-mediated tau splicing reduces behavioral deficits and tau pathology in a tauopathy model" abstract presented at Keystone Symposium: Alzheimer's Disease, Mar. 2-7, 2014, Keystone, CO.

Schoch et al., "Antisense oligonucleotide-mediated tau splicing reduces behavioral deficits and tau pathology in a tauopathy model" poster presented at Keystone Symposium: Alzheimer's Disease, Mar. 2-7, 2014, Keystone, CO.

Shea et al., "Synthesis, hybridization properties and antiviral activity of lipid-oligodeoxynucleotide conjugates" Nucl. Acids Res. (1990) 18(13):3777-3783.

Singh et al., "LNA (locked nucleic acids): synthesis and high-affinity nucleic acid recognition" Chem. Commun. (1998) 455-456.

Singh et al., "Synthesis of 2'-amino-LNA: A novel conformationally restricted high-affinity oligonucleotide analogue with a handle" J. Org. Chem. (1998) 63: 10035-10039.

Smith et al., "Comparison of Biosequences" Adv. Appl. Math. (1981) 2: 482-489.

Sproat et al., "Highly efficient chemical synthesis of 2'-O-methyloligoribonucleotides and tetrabiotinylated derivatives; novel probes that are resistant to degradation by RNA or DNA specific nucleases" Nucleic Acids Res. (1989) 17(9): 3373-3386.

Srivastava et al., "Five- and Six-Membered Conformationally Locked 2',4'-Carbocyclic ribo-Thymidines: Synthesis, Structure, and Biochemical Studies" J. Am. Chem. Soc. (2007) 129(26):8362-8379.

Svinarchuk et al., "Inhibition of HIV proliferation in MT-4 cells by antisense oligonucleotide conjugated to lipophilic groups" Biochimie (1993) 75:49-54.

Usman et al., "Exploiting the chemical synthesis of RNA," Trends in Biochemical Sciences, Elsevier, Haywards, GB (1992) 17(9): 334-339.

Verdel et al., "RNAi-Mediated Targeting of Heterochromatin by the RITS Complex" Science (2004) 303: 672-676.

Volpe et al., "Regulation of Heterochromatic Silencing and Histone H3 Lysine-9 Methylation by RNAi" Science (2002) 297: 1833-1837.

Wahlestedt et al., "Potent and nontoxic antisense oligonucleotide containing locked nucleic acids" Proc. Natl. Acad. Sci. USA (2000) 97: 5633-5638.

Walder et al., "Role of RNase H in hybrid-arrested translation by antisense oligonucleotides." Proc. Natl. Acad. Sci. USA (1988) 85(14): 5011-5015.

Wang et al., "A Novel Tau Transcript in Cultured Human Neuroblastoma Cells Expression Nuclear Tau" J. Cell Biol. (1993) 121(2):257-267.

Wolfe M.S., "The Roll of Tau in Neurodegenerative Diseases and Its Potential as a Therapeutic Target" Scientifica (2012) 1-20.

Woolf et al., "Specificity of antisense oligonucleotides in vivo" Proc. Natl. Acad. Sci. USA (1992) 89:7305-7309.

Yamada et al., "In vivo microdialysis reveals age-dependent decrease of brain interstitial fluid tau levels in P301S human tau transgenic mice." Neurosci. (2011) 31: 13110-13117.

Yoshiyama et al., "Synapse Loss and Microglial Activation Precede Tangles in a P301S Tauopathy Mouse Model" Neuron (2007) 53: 337-351.

Zhang et al., "PowerBLAST: A New Network BLAST Application for Interactive or Automated Sequence Analysis and Annotation" Genome Res. (1997) 7:649-656.

Zhou et al., "Fine Tuning of Electrostatics around the Internucleotidic Phosphate through Incorporation of Modified 2',4'-Carbocyclic-LNAs and -ENAs Leads to Significant Modulation of Antisense Properties" J. Org. Chem. (2009) 74:118-134.

GenBank Accession No. AK226139.1 (retrieved online Apr. 10, 2015).

GenBank Accession No. NM_001123066.3 (retrieved online Apr. 10, 2015).

GenBank Accession No. NM_001123067.3 (retrieved online Apr. 10, 2015).

GenBank Accession No. NM_001203251.1 (retrieved online Apr. 10, 2015).

GenBank Accession No. NM_001203252.1 (retrieved online Apr. 10, 2015).

GenBank Accession No. NM_005910.5 (retrieved online Apr. 10, 2015).

GenBank Accession No. NM_016834.4 (retrieved online Apr. 10, 2015).

GenBank Accession No. NM_016835.4 (retrieved online Apr. 10, 2015).

GenBank Accession No. NM_016841.4 (retrieved online Apr. 10, 2015).

GenBank Accession No. NT_010783.14 (retrieved online Apr. 10, 2015).

GenBank Accession No. NT_010783.15 (retrieved online Apr. 10, 2015).

Wolfe M.S., "Tau Mutations in Neurodegenrative Diseases" J. Biol Chem (2009) 284(10):3021-3025.

European Examination Report for Application No. 14767904.7 dated Sep. 19, 2016.

(56) References Cited

OTHER PUBLICATIONS

Gordon et al., "Antisense suppression of tau in cultured rat olgodendrocytes inhibits process formation," Journal of Neuroscience Research (2008) 86: 2591-2601.
Spicakova et al., "Expression and silencing of the microtubule-associated protein Tau in breast cancer cells," Molecular Cancer Therapeutics (2010) 9: 2970-2981.
DeVos et al., "Tau Reduction Prevents Neuronal Loss and Reverses Pathological Tau Deposition and Seeding in Mice with Tauopathy," Science Translational Medicine, 2017, 9(374):1-14.
International Search Report for application PCT/US2014/047486 dated Feb. 9, 2015, 12 pages.
International Search Report for application PCT/US2015/042740 dated Feb. 4, 2016, 13 pages.

\* cited by examiner

COMPOSITIONS FOR MODULATING TAU EXPRESSION

SEQUENCE LISTING

The present application is being filed along with a Sequence Listing in electronic format. The Sequence Listing is provided as a file entitled BIOL0227USASEQ_ST25.TXT, created Jan. 19, 2016, which is 916 Kb in size. The information in the electronic format of the sequence listing is incorporated herein by reference in its entirety.

FIELD

Provided are compositions and methods for reducing expression of Tau mRNA and protein in an animal. Such methods are useful to treat, prevent, or ameliorate neurodegenerative diseases, including Tauopathies, Alzheimer's Disease, Fronto-temporal Dementia (FTD), FTDP-17, Progressive Supranuclear Palsy (PSP), Chronic Traumatic Encephalopathy (CTE), Corticobasal Ganglionic Degeneration (CBD), Epilepsy, and Dravet's Syndrome by inhibiting expression of Tau in an animal.

BACKGROUND

The primary function of Tau is to bind to and stabilize microtubules, which are important structural components of the cytoskeleton involved in mitosis, cytokinesis, and vesicular transport. Tau is found in multiple tissues, but is particularly abundant in axons of neurons. In humans, there are six isoforms of Tau that are generated by alternative splicing of exons 2, 3, and 10. Splicing of exons 2 and 3 at the N-terminus of the protein leads to inclusion of zero, one, or two 29 amino acid acidic domains and is termed 0N, 1N, or 2N Tau respectively. The influence of these domains on Tau function is not fully clear, though may play a role in interactions with the plasma membrane. Inclusion of exon 10 at the C-terminus leads to inclusion of the microtubule binding domain encoded by exon 10. Since there are 3 microtubule binding domains elsewhere in Tau, this Tau isoform (with exon 10 included) is termed 4R Tau, where 'R' refers to the number of repeats of microtubule binding domains. Tau without exon 10 is termed 3R Tau. Since more microtubule binding domains (4R compared with 3R) increases the binding to microtubules, 4R Tau presumably significantly increases microtubule binding and assembly. The ratio of 3R/4R Tau is developmentally regulated, with fetal tissues expressing exclusively 3R Tau and adult human tissues expressing approximately equal levels of 3R/4R Tau. Deviations from the normal ratio of 3R/4R Tau are characteristic of neurodegenerative FTD Tauopathies. It is not known how changing the 3R/4R Tau ratio at a later stage in the adult animal will affect Tau pathogenesis.

Serine-threonine directed phosphorylation regulates the microtubule binding ability of Tau. Hyperphosphorylation promotes detachment of Tau from microtubules. Other post translational modifications of Tau have been described; however the significance of these is unclear. Phosphorylation of Tau is also developmentally regulated with higher phosphorylation in fetal tissues and much lower phosphorylation in the adult. One characteristic of neurodegenerative disorders is aberrantly increased Tau phosphorylation.

The microtubule network is involved in many important processes within the cell including structural integrity needed for maintaining morphology of cells and operating transport machinery. Since binding of Tau to microtubules stabilizes microtubules, Tau is likely to be a key mediator of some of these processes and disruption of normal Tau in neurodegenerative diseases may disrupt some of these key cellular processes.

One of the early indicators that Tau may be important in neurodegenerative syndromes was the recognition that Tau is a key component of neurofibrillary inclusions in Alzheimer's disease. In fact, neurofibrillary inclusions are aggregates of hyperphosphorylated Tau protein. Along with amyloid beta containing plaques, neurofibrillary inclusions are a hallmark of Alzheimer's disease and correlate significantly with cognitive impairment. 95% of Tau accumulations in AD are found in neuronal processes and is termed neuritic dystrophy. The process(es) whereby this microtubule associated protein becomes disengaged from microtubules and forms accumulations of proteins and how this relates to neuronal toxicity is not well understood.

Neuronal Tau inclusions are a pathological characteristic of not only Alzheimer's disease, but also a subset of Frontotemporal dementia (FTD), PSP, and CBD. The link between Tau and neurodegeneration was solidified by the discovery that mutations in the Tau gene cause a subset of FTD. These genetic data have also highlighted the importance of the 3R:4R ratio of Tau. Many of the Tau mutations that cause FTD lead to a change in Tau splicing which leads to preferential inclusion of exon 10, and thus to increased 4R Tau. The overall Tau levels are normal. Whether the Tau isoform change or the amino acid change or both cause neurodegeneration remains unknown. Recent data suggest that PSP may also be associated with an increased 4R:3R Tau ratio.

To help understand the influence of Tau ratios on neurodegeneration, a mouse model based on one of the splicing Tau mutations (N279K) has been generated using a minigene that includes the Tau promoter and the flanking intronic sequences of exon 10. As in humans, these mice demonstrate increased levels of 4R Tau compared with transgenics expressing WT Tau and develop behavioral and motor abnormalities as well as accumulations of aggregated Tau in the brain and spinal cord.

The protein "Tau" has been associated with multiple diseases of the brain including Alzheimer's disease, frontotemporal dementia, progressive supranuclear palsy, corticobasal ganglionic degeneration, dementia pugilistica, parkinsonism linked to chromosome, Lytico-Bodig disease, tangle-predominant dementia, ganglioglioma, gangliocytoma, meningioangiomatosis, subacute sclerosing panencephalitis, lead encephalopathy, tuberous sclerosis, Hallervorden-Spatz disease, Pick's disease, argyrophilic grain disease, corticobasal degeneration or frontotemporal lobar degeneration and others. Tau-associated disorders such as AD are the most common cause of dementia in the elderly. AD affects an estimated 15 million people worldwide and 40% of the population above 85 years of age. AD is characterized by two pathological hallmarks: Tau neurofibrillary inclusions (NFT) and amyloid-β (Aβ) plaques.

There is currently a lack of acceptable options for treating such neurodegenerative diseases. It is therefore an object herein to provide methods for the treatment of such diseases.

SUMMARY

Provided herein are methods, compounds, and compositions for modulating expression of Tau mRNA and protein. In certain embodiments, compounds useful for modulating expression of Tau mRNA and protein are antisense compounds. In certain embodiments, the antisense compounds are antisense oligonucleotides.

In certain embodiments, modulation can occur in a cell or tissue. In certain embodiments, the cell or tissue is in an animal. In certain embodiments, the animal is a human. In certain embodiments, Tau mRNA levels are reduced. In certain embodiments, Tau protein levels are reduced. Such reduction can occur in a time-dependent manner or in a dose-dependent manner.

Also provided are methods, compounds, and compositions useful for preventing, treating, and ameliorating diseases, disorders, and conditions. In certain embodiments, such Tau related diseases, disorders, and conditions are neurodegenerative diseases. In certain embodiments, such neurodegenerative diseases, disorders, and conditions include Tauopathies, Alzheimer's Disease, Fronto-temporal Dementia (FTD), FTDP-17, Progressive Supranuclear Palsy (PSP), Chronic Traumatic Encephalopathy (CTE), Corticobasal Ganglionic Degeneration (CBD), Epilepsy, and Dravet's Syndrome Such diseases, disorders, and conditions can have one or more risk factors, causes, or outcomes in common Certain risk factors and causes for development of neurodegenerative disorder include growing older, having a personal or family history, or genetic predisposition. Certain symptoms and outcomes associated with development of a neurodegenerative disorder include but are not limited to: presence of hyperphosphorylated Tau, presence of neurofibrillary inclusions, reduction of neurological function, reduced memory, reduced motor function, reduced motor coordination, and confusion.

In certain embodiments, methods of treatment include administering a Tau antisense compound to an individual in need thereof. In certain embodiments, methods of treatment include administering a Tau antisense oligonucleotide to an individual in need thereof.

The present disclosure provides the following non-limiting numbered embodiments:

Embodiment 1: A compound, comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 consecutive nucleobases of any of the nucleobase sequences of SEQ ID NOs: 20-2443 and SEQ ID NOs: 2478-2483.

Embodiment 2: A compound, comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 consecutive nucleobases of any of the nucleobase sequences of SEQ ID NOs: 2444-2477 and SEQ ID NOs: 2484-2565.

Embodiment 3: A compound, comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 consecutive nucleobases of any of the nucleobase sequences of SEQ ID NOs: 20-2565.

Embodiment 4: A compound, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 135783-135980 of SEQ ID NO: 1.

Embodiment 5: A compound, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 135853-135872 of SEQ ID NO: 1.

Embodiment 6: A compound, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 135783-135929 of SEQ ID NO: 1.

Embodiment 7: A compound, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 135783-135914 of SEQ ID NO: 1.

Embodiment 8: The compound of embodiments 4-7, wherein the nucleobase sequence of the modified oligonucleotide is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% complementary to SEQ ID NO: 1.

Embodiment 9: The compound of any preceding embodiment, consisting of a single-stranded modified oligonucleotide.

Embodiment 10: The compound of any preceding embodiment, wherein at least one internucleoside linkage is a modified internucleoside linkage.

Embodiment 11: The compound of embodiment 10, wherein at least one modified internucleoside linkage is a phosphorothioate internucleoside linkage.

Embodiment 12: The compound of embodiment 10, wherein each modified internucleoside linkage is a phosphorothioate internucleoside linkage.

Embodiment 13: The compound of any preceding embodiment, wherein at least one internucleoside linkage is a phosphodiester internucleoside linkage.

Embodiment 14: The compound of any preceding embodiment, wherein at least one internucleoside linkage is a phosphorothioate linkage and at least one internucleoside linkage is a phosphodiester linkage.

Embodiment 15: The compound of any preceding embodiment, wherein at least one nucleoside comprises a modified nucleobase.

Embodiment 16: The compound of embodiment 15, wherein the modified nucleobase is a 5-methylcytosine Embodiment 17: The compound of any preceding embodiment, wherein at least one nucleoside of the modified oligonucleotide comprises a modified sugar.

Embodiment 18: The compound of embodiment 17, wherein the at least one modified sugar is a bicyclic sugar.

Embodiment 19: The compound of embodiment 18, wherein the bicyclic sugar comprises a chemical link between the 2' and 4' position of the sugar 4'-CH2-N(R)—O-2' bridge wherein R is, independently, H, C1-C12 alkyl, or a protecting group.

Embodiment 20: The compound of embodiment 18, wherein the bicyclic sugar comprises a 4'-CH2-N(R)—O-2' bridge wherein R is, independently, H, C1-C12 alkyl, or a protecting group.

Embodiment 21: The compound of embodiment 17, wherein at least one modified sugar comprises a 2'-O-methoxyethyl group.

Embodiment 22: The compound of embodiment 17, wherein the modified sugar comprises a 2'-O(CH$_2$)$_2$—OCH$_3$ group.

Embodiment 23: The compound of any preceding embodiment, wherein the modified oligonucleotide comprises:
a gap segment consisting of 10 linked deoxynucleosides;
a 5' wing segment consisting of 5 linked nucleosides; and
a 3' wing segment consisting of 5 linked nucleosides;
wherein the gap segment is positioned between the 5' wing segment and the 3' wing segment and wherein each nucleoside of each wing segment comprises a modified sugar.

Embodiment 24: The compound of any preceding embodiment, wherein the modified oligonucleotide comprises:
a gap segment consisting of 9 linked deoxynucleosides;
a 5' wing segment consisting of 5 linked nucleosides; and
a 3' wing segment consisting of 5 linked nucleosides;
wherein the gap segment is positioned between the 5' wing segment and the 3' wing segment and wherein each nucleoside of each wing segment comprises a modified sugar.

Embodiment 25: The compound of any preceding embodiment, wherein the modified oligonucleotide comprises:
a gap segment consisting of 7 linked deoxynucleosides;
a 5' wing segment consisting of 5 linked nucleosides; and
a 3' wing segment consisting of 6 linked nucleosides;
wherein the gap segment is positioned between the 5' wing segment and the 3' wing segment and wherein each nucleoside of each wing segment comprises a modified sugar.

Embodiment 26: The compound of any preceding embodiment, wherein the modified oligonucleotide comprises:
a gap segment consisting of 8 linked deoxynucleosides;
a 5' wing segment consisting of 5 linked nucleosides; and
a 3' wing segment consisting of 5 linked nucleosides;
wherein the gap segment is positioned between the 5' wing segment and the 3' wing segment and wherein each nucleoside of each wing segment comprises a modified sugar.

Embodiment 27: The compound of any preceding embodiment, wherein the modified oligonucleotide comprises:
a gap segment consisting of 8 linked deoxynucleosides;
a 5' wing segment consisting of 4 linked nucleosides; and
a 3' wing segment consisting of 6 linked nucleosides;
wherein the gap segment is positioned between the 5' wing segment and the 3' wing segment and wherein each nucleoside of each wing segment comprises a modified sugar.

Embodiment 28: The compound of any preceding embodiment, wherein the modified oligonucleotide comprises:
a gap segment consisting of 8 linked deoxynucleosides;
a 5' wing segment consisting of 6 linked nucleosides; and
a 3' wing segment consisting of 4 linked nucleosides;
wherein the gap segment is positioned between the 5' wing segment and the 3' wing segment and wherein each nucleoside of each wing segment comprises a modified sugar.

Embodiment 29: The compound of any preceding embodiment, wherein the modified oligonucleotide consists of 20 linked nucleosides.

Embodiment 30: The compound of any preceding embodiment, wherein the modified oligonucleotide consists of 19 linked nucleosides.

Embodiment 31: The compound of any preceding embodiment, wherein the modified oligonucleotide consists of 18 linked nucleosides.

Embodiment 32: A composition comprising the compound of any preceding embodiment or salt thereof and at least one of a pharmaceutically acceptable carrier or diluent.

Embodiment 33 A method comprising administering to an animal the compound or composition of any preceding embodiment.

Embodiment 34: The method of embodiment 33, wherein the animal is a human

Embodiment 35: The method of embodiment 33, wherein administering the compound prevents, treats, ameliorates, or slows progression of a tau associated disease, disorder or condition.

Embodiment 36: The method of embodiment 35, wherein the disease, disorder or condition is a Tauopathy, Alzheimer's Disease, Fronto-temporal Dementia (FTD), FTDP-17, Progressive Supranuclear Palsy (PSP), Chronic Traumatic Encephalopathy (CTE), Corticobasal Ganglionic Degeneration (CBD), Epilepsy, or Dravet's Syndrome.

Embodiment 37: Use of the compound or composition of any preceding embodiment for the manufacture of a medicament for treating a neurodegenerative disorder.

Embodiment 38: A compound consisting of ISIS 613099
Embodiment 39: A compound consisting of ISIS 613361
Embodiment 40: A compound consisting of ISIS 613370
Embodiment 41: A compound consisting of ISIS 623782
Embodiment 42: A compound consisting of ISIS 623996
Embodiment 43: A composition comprising the compound of any of embodiments 38-42, or salt thereof, and at least one of a pharmaceutically acceptable carrier or diluent.

Embodiment 44: A method comprising administering to an animal the compound or composition of any of embodiments 38-43.

Embodiment 45: The method of embodiment 44, wherein the animal is a human

Embodiment 46: The method of embodiment 44, wherein administering the compound prevents, treats, ameliorates, or slows progression of a tau associated disease, disorder or condition.

Embodiment 47: The method of embodiment 46, wherein the disease, disorder or condition is a Tauopathy, Alzheimer's Disease, Fronto-temporal Dementia (FTD), FTDP-17, Progressive Supranuclear Palsy (PSP), Chronic Traumatic Encephalopathy (CTE), Corticobasal Ganglionic Degeneration (CBD), Epilepsy, or Dravet's Syndrome.

Embodiment 48: Use of the compound or composition of any of embodiments 38-43 for the manufacture of a medicament for treating a neurodegenerative disorder.

DETAILED DESCRIPTION

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Additionally, as used herein, the use of "and" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this disclosure, including, but not limited to, patents, patent applications, published patent applications, articles, books, treatises, and GENBANK Accession Numbers and associated sequence information obtainable through databases such as National Center for Biotechnology Information (NCBI) and other data referred to throughout in the disclosure herein are hereby expressly incorporated by reference for the portions of the document discussed herein, as well as in their entirety.

DEFINITIONS

Unless specific definitions are provided, the nomenclature utilized in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis.

Unless otherwise indicated, the following terms have the following meanings:

"2'-O-methoxyethyl" (also 2'-MOE and 2'-OCH$_2$CH$_2$—OCH$_3$ and MOE) refers to an O-methoxyethyl modification of the 2' position of a furanose ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" means a nucleoside comprising a substituent at the 2'-position of the furanose ring other than H or OH. In certain embodiments, 2' substituted nucleosides include nucleosides with bicyclic sugar modifications.

"5-methylcytosine" means a cytosine modified with a methyl group attached to the 5 position. A 5-methylcytosine is a modified nucleobase.

"About" means within ±7% of a value. For example, if it is stated, "the compounds affected at least about 70% inhibition of Tau", it is implied that the Tau levels are inhibited within a range of 63% and 77%.

"Administered concomitantly" refers to the co-administration of two pharmaceutical agents in any manner in which the pharmacological effects of both are manifest in the patient at the same time. Concomitant administration does not require that both pharmaceutical agents be administered in a single pharmaceutical composition, in the same dosage form, or by the same route of administration. The effects of both pharmaceutical agents need not manifest themselves at the same time. The effects need only be overlapping for a period of time and need not be coextensive.

"Administering" means providing a pharmaceutical agent to an animal and includes, but is not limited to administering by a medical professional and self-administering.

"Amelioration" refers to a lessening, slowing, stopping, or reversing of at least one indicator of the severity of a condition or disease. The severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antibody" refers to a molecule characterized by reacting specifically with an antigen in some way, where the antibody and the antigen are each defined in terms of the other. Antibody may refer to a complete antibody molecule or any fragment or region thereof, such as the heavy chain, the light chain, Fab region, and Fc region.

"Antisense activity" means any detectable or measurable activity attributable to the hybridization of an antisense compound to its target nucleic acid. In certain embodiments, antisense activity is a decrease in the amount or expression of a target nucleic acid or protein encoded by such target nucleic acid.

"Antisense compound" means an oligomeric compound that is capable of undergoing hybridization to a target nucleic acid through hydrogen bonding. Examples of antisense compounds include single-stranded and double-stranded compounds, such as, antisense oligonucleotides, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels or in the absence of the antisense compound.

"Antisense mechanisms" are all those mechanisms involving hybridization of a compound with a target nucleic acid, wherein the outcome or effect of the hybridization is either target degradation or target occupancy with concomitant stalling of the cellular machinery involving, for example, transcription or splicing.

"Antisense oligonucleotide" means a single-stranded oligonucleotide having a nucleobase sequence that permits hybridization to a corresponding segment of a target nucleic acid.

"Base complementarity" refers to the capacity for the precise base pairing of nucleobases of an antisense oligonucleotide with corresponding nucleobases in a target nucleic acid (i.e., hybridization), and is mediated by Watson-Crick, Hoogsteen or reversed Hoogsteen hydrogen binding between corresponding nucleobases.

"Bicyclic sugar" means a furanose ring modified by the bridging of two atoms. A bicyclic sugar is a modified sugar.

"Bicyclic nucleoside" (also BNA) means a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring.

"Cap structure" or "terminal cap moiety" means chemical modifications, which have been incorporated at either terminus of an antisense compound.

"cEt" or "constrained ethyl" means a bicyclic nucleoside having a sugar moiety comprising a bridge connecting the 4'-carbon and the 2'-carbon, wherein the bridge has the formula: 4'-CH(CH$_3$)—O-2'.

"Constrained ethyl nucleoside" (also cEt nucleoside) means a nucleoside comprising a bicyclic sugar moiety comprising a 4'-CH(CH$_3$)—O-2' bridge.

"Chemically distinct region" refers to a region of an antisense compound that is in some way chemically different than another region of the same antisense compound. For example, a region having 2'-O-methoxyethyl nucleosides is chemically distinct from a region having nucleosides without 2'-O-methoxyethyl modifications.

"Chimeric antisense compound" means an antisense compound that has at least two chemically distinct regions, each position having a plurality of subunits.

"Co-administration" means administration of two or more pharmaceutical agents to an individual. The two or more pharmaceutical agents may be in a single pharmaceutical composition, or may be in separate pharmaceutical compositions. Each of the two or more pharmaceutical agents may be administered through the same or different routes of administration. Co-administration encompasses parallel or sequential administration.

"Complementarity" means the capacity for pairing between nucleobases of a first nucleic acid and a second nucleic acid.

"Comprise," "comprises," and "comprising" will be understood to imply the inclusion of a stated step or element or group of steps or elements but not the exclusion of any other step or element or group of steps or elements.

"Contiguous nucleobases" means nucleobases immediately adjacent to each other.

"Designing" or "designed to" refer to the process of designing an oligomeric compound that specifically hybridizes with a selected nucleic acid molecule.

"Diluent" means an ingredient in a composition that lacks pharmacological activity, but is pharmaceutically necessary or desirable. For example, in drugs that are injected, the diluent may be a liquid, e.g. saline solution.

"Dose" means a specified quantity of a pharmaceutical agent provided in a single administration, or in a specified time period. In certain embodiments, a dose may be administered in one, two, or more boluses, tablets, or injections. For example, in certain embodiments where subcutaneous administration is desired, the desired dose requires a volume not easily accommodated by a single injection, therefore, two or more injections may be used to achieve the desired dose. In certain embodiments, the pharmaceutical agent is administered by infusion over an extended period of time or continuously. Doses may be stated as the amount of pharmaceutical agent per hour, day, week, or month.

"Effective amount" in the context of modulating an activity or of treating or preventing a condition means the administration of that amount of pharmaceutical agent to a subject in need of such modulation, treatment, or prophylaxis, either in a single dose or as part of a series, that is effective for modulation of that effect, or for treatment or prophylaxis or improvement of that condition. The effective amount may vary among individuals depending on the health and physical condition of the individual to be treated, the taxonomic group of the individuals to be treated, the formulation of the composition, assessment of the individual's medical condition, and other relevant factors.

"Efficacy" means the ability to produce a desired effect.

"Expression" includes all the functions by which a gene's coded information is converted into structures present and operating in a cell. Such structures include, but are not limited to the products of transcription and translation.

"Fully complementary" or "100% complementary" means each nucleobase of a first nucleic acid has a complementary nucleobase in a second nucleic acid. In certain embodiments, a first nucleic acid is an antisense compound and a target nucleic acid is a second nucleic acid.

"Gapmer" means a chimeric antisense compound in which an internal region having a plurality of nucleosides that support RNase H cleavage is positioned between external regions having one or more nucleosides, wherein the nucleosides comprising the internal region are chemically distinct from the nucleoside or nucleosides comprising the external regions. The internal region may be referred to as a "gap" and the external regions may be referred to as the "wings."

"Gap-narrowed" means a chimeric antisense compound having a gap segment of 9 or fewer contiguous 2'-deoxyribonucleosides positioned between and immediately adjacent to 5' and 3' wing segments having from 1 to 6 nucleosides.

"Gap-widened" means a chimeric antisense compound having a gap segment of 12 or more contiguous 2'-deoxyribonucleosides positioned between and immediately adjacent to 5' and 3' wing segments having from 1 to 6 nucleosides.

"Hybridization" means the annealing of complementary nucleic acid molecules. In certain embodiments, complementary nucleic acid molecules include, but are not limited to, an antisense compound and a target nucleic acid. In certain embodiments, complementary nucleic acid molecules include, but are not limited to, an antisense oligonucleotide and a nucleic acid target.

"Identifying an animal having a Tau associated disease" means identifying an animal having been diagnosed with a Tau associated disease or predisposed to develop a Tau associated disease. Individuals predisposed to develop a Tau associated disease include those having one or more risk factors for developing a Tau associated disease, including, growing older, having a personal or family history, or genetic predisposition of one or more Tau associated diseases. Such identification may be accomplished by any method including evaluating an individual's medical history and standard clinical tests or assessments, such as genetic testing.

"Immediately adjacent" means there are no intervening elements between the immediately adjacent elements.

"Individual" means a human or non-human animal selected for treatment or therapy.

"Inhibiting Tau" means reducing the level or expression of a Tau mRNA and/or protein. In certain embodiments, Tau mRNA and/or protein levels are inhibited in the presence of an antisense compound targeting Tau, including an antisense oligonucleotide targeting Tau, as compared to expression of Tau mRNA and/or protein levels in the absence of a Tau antisense compound, such as an antisense oligonucleotide.

"Inhibiting the expression or activity" refers to a reduction or blockade of the expression or activity and does not necessarily indicate a total elimination of expression or activity.

"Internucleoside linkage" refers to the chemical bond between nucleosides.

"Linked nucleosides" means adjacent nucleosides linked together by an internucleoside linkage.

"Locked nucleic acid" or "LNA" or "LNA nucleosides" means nucleic acid monomers having a bridge connecting two carbon atoms between the 4' and 2'position of the nucleoside sugar unit, thereby forming a bicyclic sugar. Examples of such bicyclic sugar include, but are not limited to A) α-L-Methyleneoxy (4'-$CH_2$—O-2') LNA, (B) β-D-Methyleneoxy (4'-$CH_2$—O-2') LNA, (C) Ethyleneoxy (4'-$(CH_2)_2$—O-2') LNA, (D) Aminooxy (4'-$CH_2$—O—N(R)-2') LNA and (E) Oxyamino (4'-$CH_2$—N(R)—O-2') LNA, as depicted below.

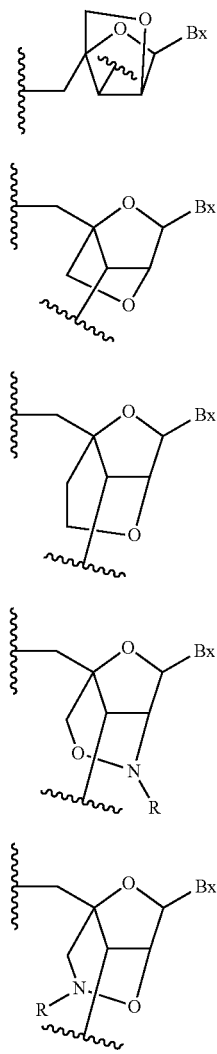

(A)
(B)
(C)
(D)
(E)

As used herein, LNA compounds include, but are not limited to, compounds having at least one bridge between the 4' and the 2' position of the sugar wherein each of the bridges independently comprises 1 or from 2 to 4 linked groups independently selected from —[C(R$_1$)(R$_2$)]$_n$—, —C(R$_1$)=C(R$_2$)—, —C(R$_1$)=N—, —C(=NR$_1$)—, —C(=O)—, —C(=S)—, —O—, —Si(R$_1$)$_2$—, —S(=O)$_x$— and —N(R$_1$)—; wherein: x is 0, 1, or 2; n is 1, 2, 3, or 4; each R$_1$ and R$_2$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, a heterocycle radical, a substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl or a protecting group.

Examples of 4'-2' bridging groups encompassed within the definition of LNA include, but are not limited to one of formulae: —[C(R$_1$)(R$_2$)]$_n$—, —[C(R$_1$)(R$_2$)]$_n$—O—, —C(R$_1$R$_2$)—N(R$_1$)—O— or —C(R$_1$R$_2$)—O—N(R$_1$)—. Furthermore, other bridging groups encompassed with the definition of LNA are 4'-CH$_2$-2', 4'-(CH$_2$)$_2$-2', 4'-(CH$_2$)$_3$-2', 4'-CH$_2$—O-2', 4'-(CH$_2$)$_2$—O-2', 4'-CH$_2$—O—N(R$_1$)-2' and 4'-CH$_2$—N(R$_1$)—O-2'-bridges, wherein each R$_1$ and R$_2$ is, independently, H, a protecting group or C$_1$-C$_{12}$ alkyl.

Also included within the definition of LNA according to the invention are LNAs in which the 2'-hydroxyl group of the ribosyl sugar ring is connected to the 4' carbon atom of the sugar ring, thereby forming a methyleneoxy (4'-CH$_2$—O-2') bridge to form the bicyclic sugar moiety. The bridge can also be a methylene (—CH$_2$—) group connecting the 2' oxygen atom and the 4' carbon atom, for which the term methyleneoxy (4'-CH$_2$—O-2') LNA is used. Furthermore; in the case of the bicylic sugar moiety having an ethylene bridging group in this position, the term ethyleneoxy (4'-CH$_2$CH$_2$—O-2') LNA is used. α-L-methyleneoxy (4'-CH$_2$—O-2'), an isomer of methyleneoxy (4'-CH$_2$—O-2') LNA is also encompassed within the definition of LNA, as used herein.

"Mismatch" or "non-complementary nucleobase" refers to the case when a nucleobase of a first nucleic acid is not capable of pairing with the corresponding nucleobase of a second or target nucleic acid.

"Modified internucleoside linkage" refers to a substitution or any change from a naturally occurring internucleoside bond (i.e., a phosphodiester internucleoside bond).

"Modified nucleobase" means any nucleobase other than adenine, cytosine, guanine, thymidine, or uracil. An "unmodified nucleobase" means the purine bases adenine (A) and guanine (G), and the pyrimidine bases thymine (T), cytosine (C), and uracil (U).

A "modified nucleoside" means a nucleoside having, independently, a modified sugar moiety and/or modified nucleobase.

"Modified nucleotide" means a nucleotide having, independently, a modified sugar moiety, modified internucleoside linkage, and/or modified nucleobase.

"Modified oligonucleotide" means an oligonucleotide comprising at least one modified internucleoside linkage, modified sugar, and/or modified nucleobase.

"Modified sugar" means substitution and/or any change from a natural sugar moiety.

"Monomer" means a single unit of an oligomer. Monomers include, but are not limited to, nucleosides and nucleotides, whether naturally occurring or modified.

"Motif" means the pattern of unmodified and modified nucleosides in an antisense compound.

"Natural sugar moiety" means a sugar moiety found in DNA (2'-H) or RNA (2'-OH).

"Naturally occurring internucleoside linkage" means a 3' to 5' phosphodiester linkage.

"Non-complementary nucleobase" refers to a pair of nucleobases that do not form hydrogen bonds with one another or otherwise support hybridization.

"Nucleic acid" refers to molecules composed of monomeric nucleotides. A nucleic acid includes, but is not limited to, ribonucleic acids (RNA), deoxyribonucleic acids (DNA), single-stranded nucleic acids, double-stranded nucleic acids, small interfering ribonucleic acids (siRNA), and microRNAs (miRNA).

"Nucleobase" means a heterocyclic moiety capable of pairing with a base of another nucleic acid.

"Nucleobase complementarity" refers to a nucleobase that is capable of base pairing with another nucleobase. For example, in DNA, adenine (A) is complementary to thymine (T). For example, in RNA, adenine (A) is complementary to uracil (U). In certain embodiments, complementary nucleobase refers to a nucleobase of an antisense compound that is capable of base pairing with a nucleobase of its target nucleic acid. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be complementary at that nucleobase pair.

"Nucleobase sequence" means the order of contiguous nucleobases independent of any sugar, linkage, and/or nucleobase modification.

"Nucleoside" means a nucleobase linked to a sugar.

"Nucleoside mimetic" includes those structures used to replace the sugar or the sugar and the base and not necessarily the linkage at one or more positions of an oligomeric compound such as for example nucleoside mimetics having morpholino, cyclohexenyl, cyclohexyl, tetrahydropyranyl, bicyclo, or tricyclo sugar mimetics, e.g., non furanose sugar units. Nucleotide mimetic includes those structures used to replace the nucleoside and the linkage at one or more positions of an oligomeric compound such as for example peptide nucleic acids or morpholinos (morpholinos linked by —N(H)—C(=O)—O— or other non-phosphodiester linkage). Sugar surrogate overlaps with the slightly broader term nucleoside mimetic but is intended to indicate replacement of the sugar unit (furanose ring) only. The tetrahydropyranyl rings provided herein are illustrative of an example of a sugar surrogate wherein the furanose sugar group has been replaced with a tetrahydropyranyl ring system. "Mimetic" refers to groups that are substituted for a sugar, a nucleobase, and/or internucleoside linkage. Generally, a mimetic is used in place of the sugar or sugar-internucleoside linkage combination, and the nucleobase is maintained for hybridization to a selected target.

"Nucleotide" means a nucleoside having a phosphate group covalently linked to the sugar portion of the nucleoside.

"Off-target effect" refers to an unwanted or deleterious biological effect associated with modulation of RNA or protein expression of a gene other than the intended target nucleic acid.

"Oligomeric compound" or "oligomer" means a polymer of linked monomeric subunits which is capable of hybridizing to at least a region of a nucleic acid molecule.

"Oligonucleotide" means a polymer of linked nucleosides each of which can be modified or unmodified, independent one from another.

"Parenteral administration" means administration through injection (e.g., bolus injection) or infusion. Parenteral administration includes subcutaneous administration, intravenous administration, intramuscular administration, intraarterial administration, intraperitoneal administration, or intracranial administration, e.g., intrathecal or intracerebroventricular administration.

"Peptide" means a molecule formed by linking at least two amino acids by amide bonds. Without limitation, as used herein, peptide refers to polypeptides and proteins.

"Pharmaceutical agent" means a substance that provides a therapeutic benefit when administered to an individual. For example, in certain embodiments, an antisense oligonucleotide targeted to Tau is a pharmaceutical agent.

"Pharmaceutical composition" means a mixture of substances suitable for administering to a subject. For example, a pharmaceutical composition may comprise an antisense oligonucleotide and a sterile aqueous solution.

"Pharmaceutically acceptable derivative" encompasses pharmaceutically acceptable salts, conjugates, prodrugs or isomers of the compounds described herein.

"Pharmaceutically acceptable salts" means physiologically and pharmaceutically acceptable salts of antisense compounds, i.e., salts that retain the desired biological activity of the parent oligonucleotide and do not impart undesired toxicological effects thereto.

"Phosphorothioate linkage" means a linkage between nucleosides where the phosphodiester bond is modified by replacing one of the non-bridging oxygen atoms with a sulfur atom. A phosphorothioate linkage is a modified internucleoside linkage.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an antisense compound.

"Prevent" or "preventing" refers to delaying or forestalling the onset or development of a disease, disorder, or condition for a period of time from minutes to days, weeks to months, or indefinitely.

"Prodrug" means a therapeutic agent that is prepared in an inactive form that is converted to an active form (i.e., drug) within the body or cells thereof by the action of endogenous enzymes or other chemicals and/or conditions.

"Prophylactically effective amount" refers to an amount of a pharmaceutical agent that provides a prophylactic or preventative benefit to an animal.

"Region" is defined as a portion of the target nucleic acid having at least one identifiable structure, function, or characteristic.

"Ribonucleotide" means a nucleotide having a hydroxy at the 2' position of the sugar portion of the nucleotide. Ribonucleotides may be modified with any of a variety of substituents.

"Salts" mean a physiologically and pharmaceutically acceptable salts of antisense compounds, i.e., salts that retain the desired biological activity of the parent oligonucleotide and do not impart undesired toxicological effects thereto.

"Segments" are defined as smaller or sub-portions of regions within a target nucleic acid.

"Shortened" or "truncated" versions of antisense oligonucleotides taught herein have one, two or more nucleosides deleted.

"Side effects" means physiological responses attributable to a treatment other than desired effects. In certain embodiments, side effects include, without limitation, injection site reactions, liver function test abnormalities, renal function abnormalities, liver toxicity, renal toxicity, central nervous system abnormalities, and myopathies.

"Single-stranded oligonucleotide" means an oligonucleotide which is not hybridized to a complementary strand.

"Sites," as used herein, are defined as unique nucleobase positions within a target nucleic acid.

"Slows progression" means decrease in the development of the said disease.

"Specifically hybridizable" refers to an antisense compound having a sufficient degree of complementarity between an antisense oligonucleotide and a target nucleic acid to induce a desired effect, while exhibiting minimal or no effects on non-target nucleic acids under conditions in which specific binding is desired, i.e., under physiological conditions in the case of in vivo assays and therapeutic treatments.

"Stringent hybridization conditions" or "stringent conditions" refer to conditions under which an oligomeric compound will hybridize to its target sequence, but to a minimal number of other sequences.

"Subject" means a human or non-human animal selected for treatment or therapy.

"Target" refers to a protein, the modulation of which is desired.

"Target gene" refers to a gene encoding a target.

"Targeting" or "targeted" means the process of design and selection of an antisense compound that will specifically hybridize to a target nucleic acid and induce a desired effect.

"Target nucleic acid," "target RNA," and "target RNA transcript" and "nucleic acid target" all mean a nucleic acid capable of being targeted by antisense compounds.

"Target region" means a portion of a target nucleic acid to which one or more antisense compounds is targeted.

"Target segment" means the sequence of nucleotides of a target nucleic acid to which an antisense compound is targeted. "5' target site" refers to the 5'-most nucleotide of a target segment. "3' target site" refers to the 3'-most nucleotide of a target segment.

"Tau" means mammalian microtubule-associated protein tau (MAPT), including human microtubule-associated protein tau (MAPT).

"Tau associated disease" means any disease associated with any Tau nucleic acid or expression product thereof. Such diseases may include a neurodegenerative disease. Such neurodegenerative diseases may include Tauopathies, Alzheimer's Disease, Fronto-temporal Dementia (FTD), FTDP-17, Progressive Supranuclear Palsy (PSP), Chronic Traumatic Encephalopathy (CTE), Corticobasal Ganglionic Degeneration (CBD), Epilepsy, and Dravet's Syndrome.

"Tau mRNA" means any messenger RNA expression product of a DNA sequence encoding Tau.

"Tau nucleic acid" means any nucleic acid encoding Tau. For example, in certain embodiments, a Tau nucleic acid includes a DNA sequence encoding Tau, an RNA sequence transcribed from DNA encoding Tau (including genomic DNA comprising introns and exons), and an mRNA sequence encoding Tau. "Tau mRNA" means an mRNA encoding a Tau protein.

"Tau protein" means the polypeptide expression product of a Tau nucleic acid.

"Therapeutically effective amount" means an amount of a pharmaceutical agent that provides a therapeutic benefit to an individual.

"Treat" or "treating" or "treatment" refers administering a composition to effect an alteration or improvement of the disease or condition.

"Unmodified nucleobases" mean the purine bases adenine (A) and guanine (G), and the pyrimidine bases thymine (T), cytosine (C) and uracil (U).

"Unmodified nucleotide" means a nucleotide composed of naturally occurring nucleobases, sugar moieties, and internucleoside linkages. In certain embodiments, an unmodified nucleotide is an RNA nucleotide (i.e. β-D-ribonucleosides) or a DNA nucleotide (i.e. β-D-deoxyribonucleoside).

"Wing segment" means a plurality of nucleosides modified to impart to an oligonucleotide properties such as enhanced inhibitory activity, increased binding affinity for a target nucleic acid, or resistance to degradation by in vivo nucleases.

Certain Embodiments

Certain embodiments provide methods, compounds, and compositions for inhibiting Tau mRNA and protein expression. Certain embodiments provide methods, compounds, and composition for decreasing Tau mRNA and protein levels.

Certain embodiments provide antisense compounds targeted to a Tau nucleic acid. In certain embodiments, the Tau nucleic acid is the sequence set forth in GENBANK Accession No. GENBANK Accession No. NT_010783.15 truncated from nucleotides 9240000 to U.S. Pat. No. 9,381,000 (incorporated herein as SEQ ID NO: 1), GENBANK Accession No. NM_001123066.3 (incorporated herein as SEQ ID NO: 2), GENBANK Accession No. NM 016841.4, a variant mRNA sequence which skips exons 3, 4, 6, 8, 10, and 12 (incorporated herein as SEQ ID NO: 3), GENBANK Accession No. NT_010783.14 truncated from nucleotides 2624000 to U.S. Pat. No. 2,761,000 (incorporated herein as SEQ ID NO: 4), GENBANK Accession No. DR002467.1 (incorporated herein as SEQ ID NO: 5), GENBANK Accession No. NM_001203251.1 (incorporated herein as SEQ ID NO: 6), and GENBANK Accession No. NM_016835.4 (incorporated herein as SEQ ID NO: 7).

Certain embodiments provide methods for the treatment, prevention, or amelioration of diseases, disorders, and conditions associated with Tau in an individual in need thereof. Also contemplated are methods for the preparation of a medicament for the treatment, prevention, or amelioration of a disease, disorder, or condition associated with Tau. Tau associated diseases, disorders, and conditions include neurodegenerative diseases. In certain embodiments, tau associated diseases include Tauopathies, Alzheimer's Disease, Fronto-temporal Dementia (FTD), FTDP-17, Progressive Supranuclear Palsy (PSP), Chronic Traumatic Encephalopathy (CTE), Corticobasal Ganglionic Degeneration (CBD), Epilepsy, or Dravet's Syndrome.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 consecutive nucleobases of any of the nucleobase sequences of SEQ ID NOs: 20-2443 and SEQ ID NOs: 2478-2483.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 consecutive nucleobases of any of the nucleobase sequences of SEQ ID NOs: 2444-2477 and SEQ ID NOs: 2484-2565.

Certain embodiments provide compounds, comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 consecutive nucleobases of any of the nucleobase sequences of SEQ ID NOs: 20-2565.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 135783-135980 of SEQ ID NO: 1.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 135853-135872 of SEQ ID NO: 1.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 135783-135929 of SEQ ID NO: 1.

Certain embodiments provide compounds, comprising a modified oligonucleotide consisting of 12 to 30 linked nucleosides and comprising a nucleobase sequence comprising at least 8, at least 9, at least 10, at least 11, at least 12, at least 13, at least 14, at least 15, at least 16, at least 17, at least 18, at least 19, or at least 20 consecutive nucleobases complementary to an equal length portion of nucleobases 135783-135914 of SEQ ID NO: 1.

In certain embodiments the nucleobase sequence of the modified oligonucleotide is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% complementary to SEQ ID NO: 1.

In certain embodiments, the compound is a single-stranded modified oligonucleotide.

In certain embodiments, at least one internucleoside linkage of the modified oligonucleotide is a modified internucleoside linkage.

In certain embodiments, at least one modified internucleoside linkage is a phosphorothioate internucleoside linkage.

In certain embodiments, each modified internucleoside linkage is a phosphorothioate internucleoside linkage.

In certain embodiments, at least one internucleoside linkage is a phosphodiester internucleoside linkage.

In certain embodiments, at least one internucleoside linkage is a phosphorothioate linkage and at least one internucleoside linkage is a phosphodiester linkage.

In certain embodiments, at least one nucleoside comprises a modified nucleobase.

In certain embodiments, the modified nucleobase is a 5-methylcytosine.

In certain embodiments, at least one nucleoside of the modified oligonucleotide comprises a modified sugar.

In certain embodiments, at least one modified sugar is a bicyclic sugar.

In certain embodiments, the bicyclic sugar comprises a chemical link between the 2' and 4' position of the sugar 4'-CH2-N(R)—O-2' bridge wherein R is, independently, H, C1-C12 alkyl, or a protecting group.

In certain embodiments, the bicyclic sugar comprises a 4'-CH2-N(R)—O-2' bridge wherein R is, independently, H, C1-C12 alkyl, or a protecting group.

In certain embodiments, at least one modified sugar comprises a 2'-O-methoxyethyl group.

In certain embodiments, the modified sugar comprises a 2'-O(CH$_2$)$_2$—OCH$_3$ group.

In certain embodiments, the modified oligonucleotide comprises:
a gap segment consisting of 10 linked deoxynucleosides;
a 5' wing segment consisting of 5 linked nucleosides; and
a 3' wing segment consisting of 5 linked nucleosides;
wherein the gap segment is positioned between the 5' wing segment and the 3' wing segment and wherein each nucleoside of each wing segment comprises a modified sugar.

In certain embodiments, the modified oligonucleotide comprises:
a gap segment consisting of 9 linked deoxynucleosides;
a 5' wing segment consisting of 5 linked nucleosides; and
a 3' wing segment consisting of 5 linked nucleosides;
wherein the gap segment is positioned between the 5' wing segment and the 3' wing segment and wherein each nucleoside of each wing segment comprises a modified sugar.

In certain embodiments, the modified oligonucleotide comprises:
a gap segment consisting of 7 linked deoxynucleosides;
a 5' wing segment consisting of 5 linked nucleosides; and
a 3' wing segment consisting of 6 linked nucleosides;
wherein the gap segment is positioned between the 5' wing segment and the 3' wing segment and wherein each nucleoside of each wing segment comprises a modified sugar.

In certain embodiments, the modified oligonucleotide comprises:
a gap segment consisting of 8 linked deoxynucleosides;
a 5' wing segment consisting of 5 linked nucleosides; and
a 3' wing segment consisting of 5 linked nucleosides;
wherein the gap segment is positioned between the 5' wing segment and the 3' wing segment and wherein each nucleoside of each wing segment comprises a modified sugar.

In certain embodiments, the modified oligonucleotide comprises:
a gap segment consisting of 8 linked deoxynucleosides;
a 5' wing segment consisting of 4 linked nucleosides; and
a 3' wing segment consisting of 6 linked nucleosides;
wherein the gap segment is positioned between the 5' wing segment and the 3' wing segment and wherein each nucleoside of each wing segment comprises a modified sugar.

In certain embodiments, the modified oligonucleotide comprises:
a gap segment consisting of 8 linked deoxynucleosides;
a 5' wing segment consisting of 6 linked nucleosides; and
a 3' wing segment consisting of 4 linked nucleosides;
wherein the gap segment is positioned between the 5' wing segment and the 3' wing segment and wherein each nucleoside of each wing segment comprises a modified sugar.

In certain embodiments, the modified oligonucleotide consists of 20 linked nucleosides.

In certain embodiments, the modified oligonucleotide consists of 19 linked nucleosides.

In certain embodiments, the modified oligonucleotide consists of 18 linked nucleosides.

Certain embodiments provide compositions comprising any compound described herein or salt thereof and at least one of a pharmaceutically acceptable carrier or diluent.

Certain embodiments provide methods comprising administering to an animal any compound or composition described herein.

In certain embodiments, the animal is a human.

In certain embodiments, administering the compound prevents, treats, ameliorates, or slows progression of a tau associated disease, disorder or condition.

In certain embodiments, the disease, disorder or condition is a Tauopathy, Alzheimer's Disease, Fronto-temporal Dementia (FTD), FTDP-17, Progressive Supranuclear Palsy (PSP), Chronic Traumatic Encephalopathy (CTE), Cortico-basal Ganglionic Degeneration (CBD), Epilepsy, or Dravet's Syndrome.

Certain embodiments provide use of any of the compounds or compositions of described herein for the manufacture of a medicament for treating a neurodegenerative disorder.

Certain embodiments provide compounds according to the following formula (Ia):

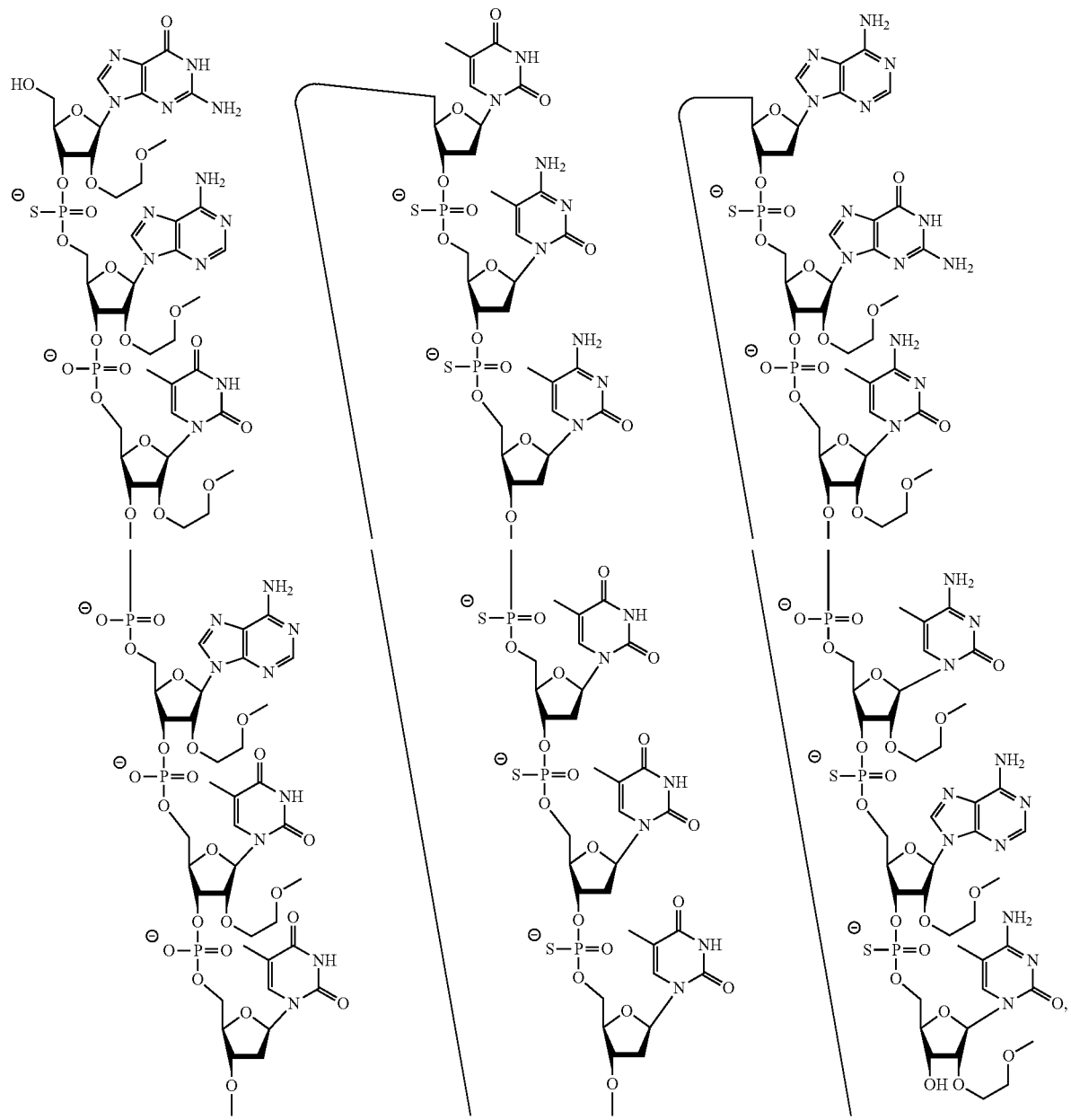

21
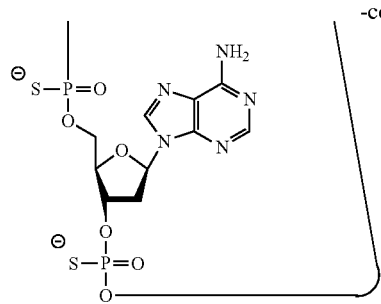
22
-continued
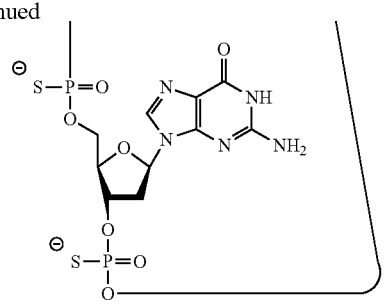
or a pharmaceutically acceptable salt thereof. In certain embodiments, provided are pharmaceutical compositions comprising the compound having the formula (Ia).
Certain embodiments provide compounds according to the following formula (IIa):
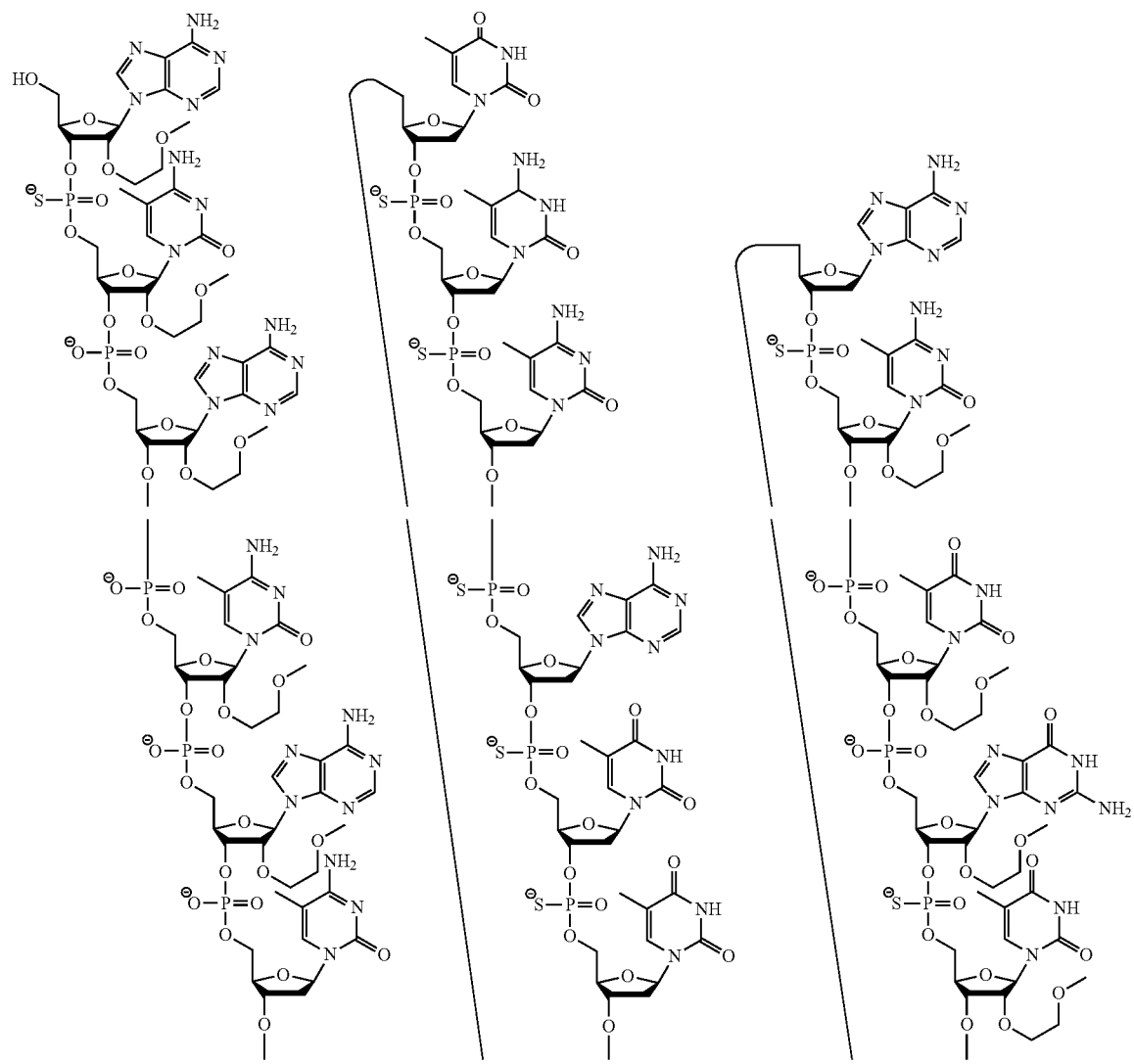
(IIa)

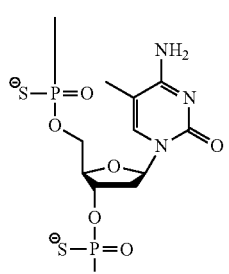
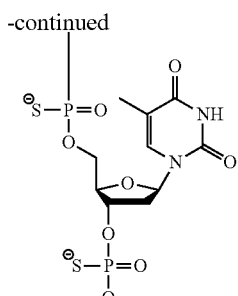
-continued
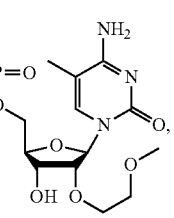
or a pharmaceutically acceptable salt thereof. In certain embodiments, provided are pharmaceutical compositions comprising the compound having the formula (IIa).
Certain embodiments provide compounds according to the following formula (IIIa):
(IIIa)
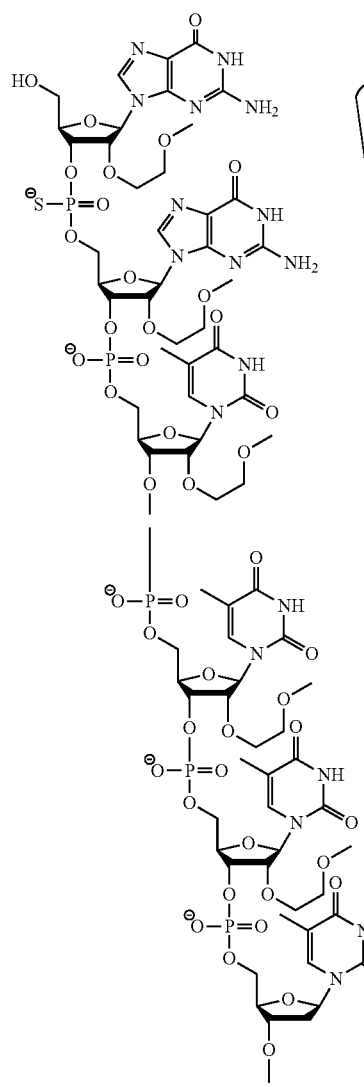
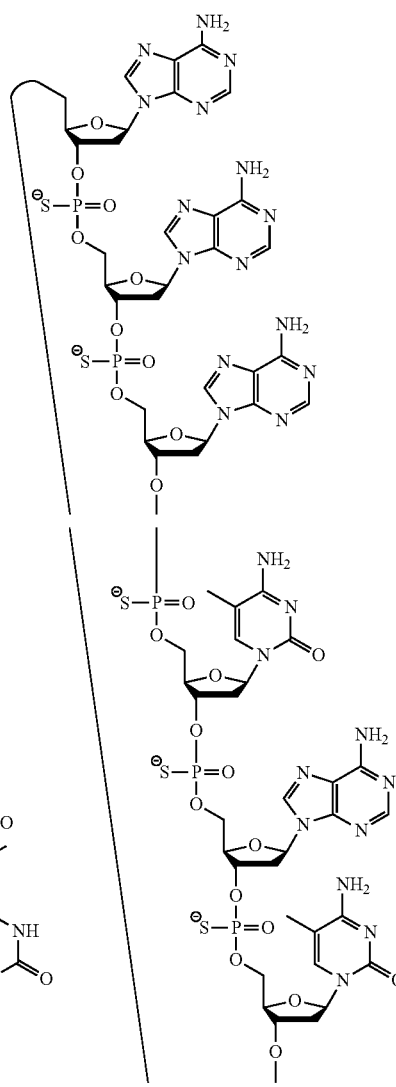
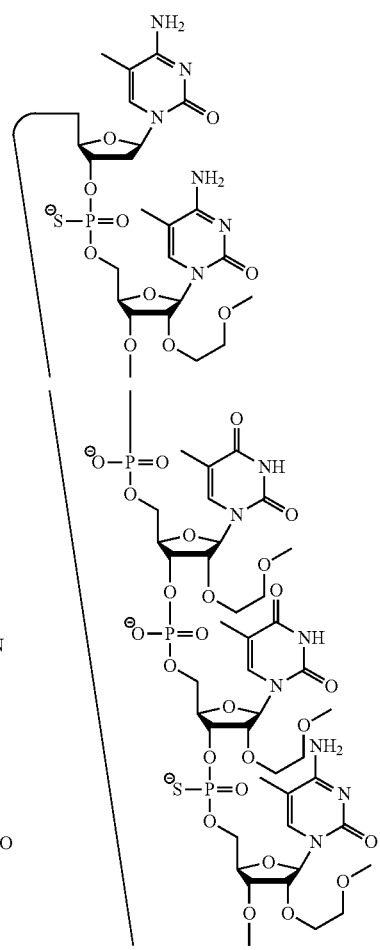

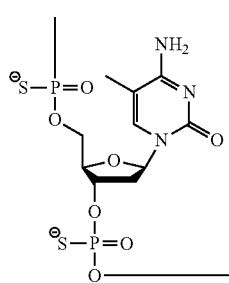
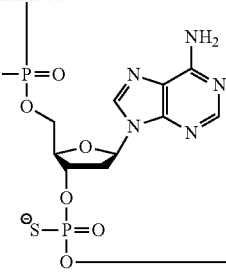
or a pharmaceutically acceptable salt thereof. In certain embodiments, provided are pharmaceutical compositions comprising the compound having the formula (Ma).
Certain embodiments provide compounds according to the following formula (IVa):
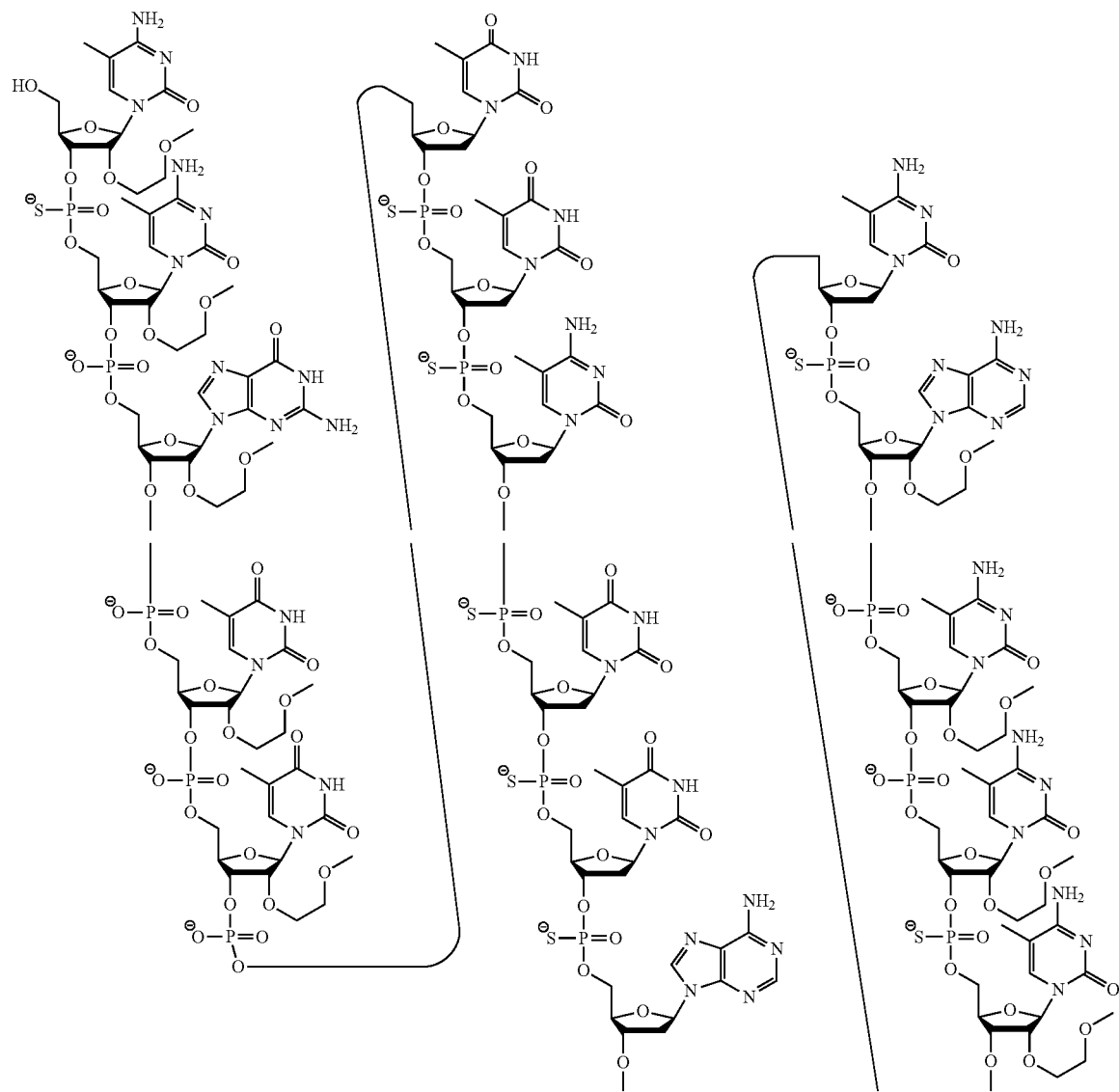
(IVa)

-continued
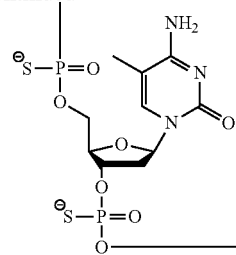 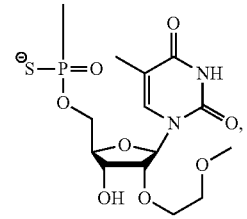
or a pharmaceutically acceptable salt thereof. In certain embodiments, provided are pharmaceutical compositions comprising the compound having the formula (IVa).
Certain embodiments provide compounds according to the following formula (Va):
(Va)
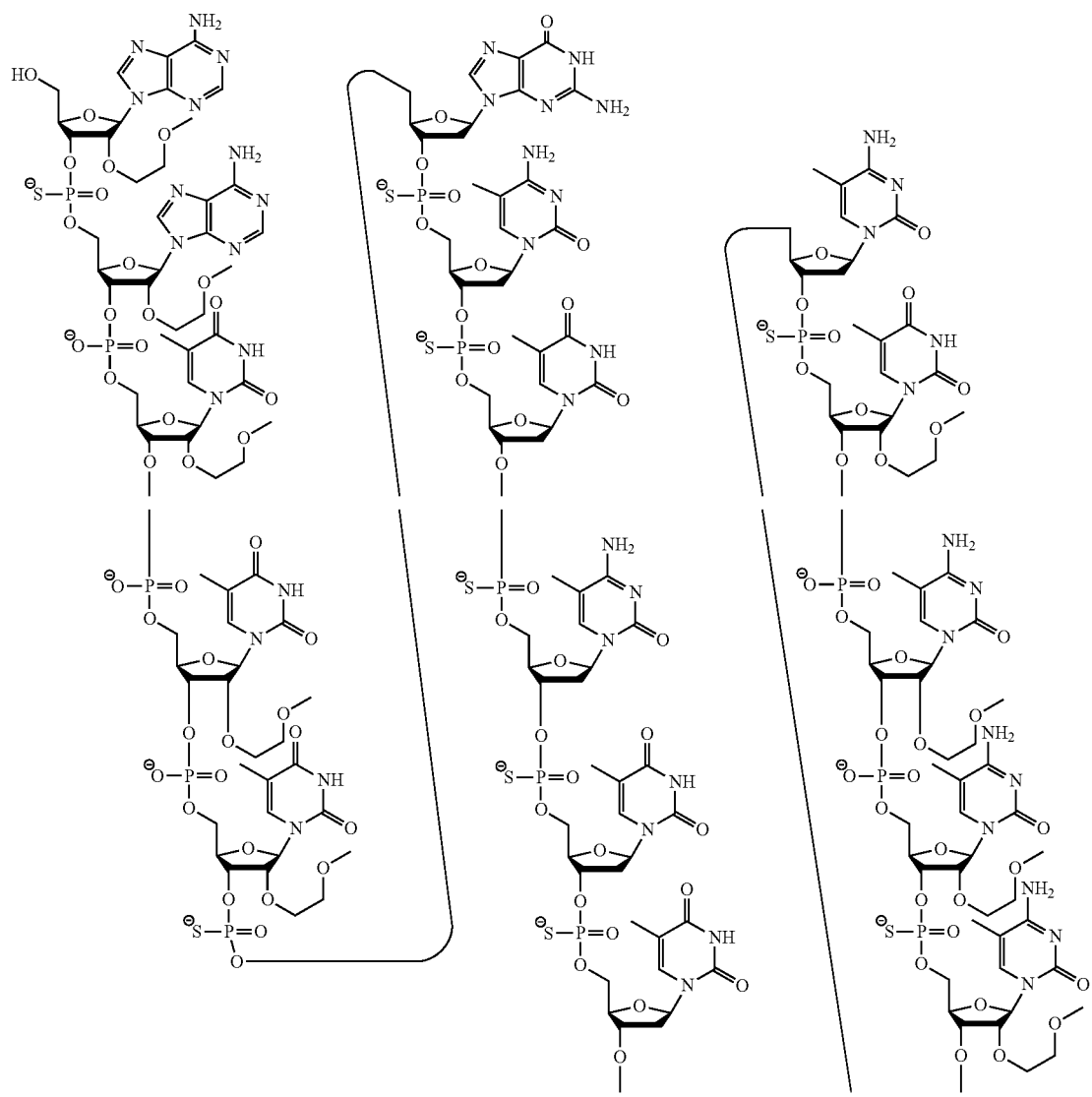

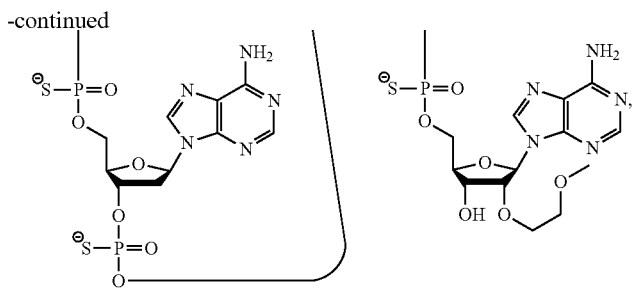

or a pharmaceutically acceptable salt thereof. In certain embodiments, provided are pharmaceutical compositions comprising the compound having the formula (Va).

Antisense Compounds

Oligomeric compounds include, but are not limited to, oligonucleotides, oligonucleosides, oligonucleotide analogs, oligonucleotide mimetics, antisense compounds, antisense oligonucleotides, and siRNAs. An oligomeric compound may be "antisense" to a target nucleic acid, meaning that is capable of undergoing hybridization to a target nucleic acid through hydrogen bonding.

In certain embodiments, an antisense compound has a nucleobase sequence that, when written in the 5' to 3' direction, comprises the reverse complement of the target segment of a target nucleic acid to which it is targeted. In certain such embodiments, an antisense oligonucleotide has a nucleobase sequence that, when written in the 5' to 3' direction, comprises the reverse complement of the target segment of a target nucleic acid to which it is targeted.

In certain embodiments, an antisense compound targeted to a Tau nucleic acid is 12 to 30 subunits in length. In certain embodiments, an antisense compound targeted to Tau nucleic acid is 12 to 25 subunits in length. In certain embodiments, an antisense compound targeted to Tau nucleic acid is 12 to 22 subunits in length. In certain embodiments, an antisense compound targeted to Tau nucleic acid is 14 to 20 subunits in length. In certain embodiments, an antisense compound targeted to Tau nucleic acid is 15 to 25 subunits in length. In certain embodiments, an antisense compound targeted to Tau nucleic acid is 18 to 22 subunits in length. In certain embodiments, an antisense compound targeted to Tau nucleic acid is 19 to 21 subunits in length. In certain embodiments, the antisense compound is 8 to 80, 12 to 50, 13 to 30, 13 to 50, 14 to 30, 14 to 50, 15 to 30, 15 to 50, 16 to 30, 16 to 50, 17 to 30, 17 to 50, 18 to 30, 18 to 50, 19 to 30, 19 to 50, or 20 to 30 linked subunits in length.

In certain embodiments, an antisense compound targeted to a Tau nucleic acid is 12 subunits in length. In certain embodiments, an antisense compound targeted to a Tau nucleic acid is 13 subunits in length. In certain embodiments, an antisense compound targeted to a Tau nucleic acid is 14 subunits in length. In certain embodiments, an antisense compound targeted to a Tau nucleic acid is 15 subunits in length. In certain embodiments, an antisense compound targeted to a Tau nucleic acid is 16 subunits in length. In certain embodiments, an antisense compound targeted to a Tau nucleic acid is 17 subunits in length. In certain embodiments, an antisense compound targeted to a Tau nucleic acid is 18 subunits in length. In certain embodiments, an antisense compound targeted to a Tau nucleic acid is 19 subunits in length. In certain embodiments, an antisense compound targeted to a Tau nucleic acid is 20 subunits in length. In certain embodiments, an antisense compound targeted to a Tau nucleic acid is 21 subunits in length. In certain embodiments, an antisense compound targeted to a Tau nucleic acid is 22 subunits in length. In certain embodiments, an antisense compound targeted to a Tau nucleic acid is 23 subunits in length. In certain embodiments, an antisense compound targeted to a Tau nucleic acid is 24 subunits in length. In certain embodiments, an antisense compound targeted to a Tau nucleic acid is 25 subunits in length. In certain embodiments, an antisense compound targeted to a Tau nucleic acid is 26 subunits in length. In certain embodiments, an antisense compound targeted to a Tau nucleic acid is 27 subunits in length. In certain embodiments, an antisense compound targeted to a Tau nucleic acid is 28 subunits in length. In certain embodiments, an antisense compound targeted to a Tau nucleic acid is 29 subunits in length. In certain embodiments, an antisense compound targeted to a Tau nucleic acid is 30 subunits in length. In certain embodiments, the antisense compound targeted to a Tau nucleic acid is 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In certain embodiments the antisense compound is an antisense oligonucleotide, and the linked subunits are nucleosides.

In certain embodiments antisense oligonucleotides targeted to a Tau nucleic acid may be shortened or truncated. For example, a single subunit may be deleted from the 5' end (5' truncation), or alternatively from the 3' end (3' truncation). A shortened or truncated antisense compound targeted to a Tau nucleic acid may have two subunits deleted from the 5' end, or alternatively may have two subunits deleted from the 3' end, of the antisense compound. Alternatively, the deleted nucleosides may be dispersed throughout the antisense compound, for example, in an antisense compound having one nucleoside deleted from the 5' end and one nucleoside deleted from the 3' end.

When a single additional subunit is present in a lengthened antisense compound, the additional subunit may be located at the 5' or 3' end of the antisense compound. When two or more additional subunits are present, the added subunits may be adjacent to each other, for example, in an antisense compound having two subunits added to the 5' end (5' addition), or alternatively to the 3' end (3' addition), of the antisense compound. Alternatively, the added subunits may be dispersed throughout the antisense compound, for example, in an antisense compound having one subunit added to the 5' end and one subunit added to the 3' end.

It is possible to increase or decrease the length of an antisense compound, such as an antisense oligonucleotide, and/or introduce mismatch bases without eliminating activity. For example, in Woolf et al. (Proc. Natl. Acad. Sci. USA 89:7305-7309, 1992), a series of antisense oligonucleotides 13-25 nucleobases in length were tested for their ability to induce cleavage of a target RNA in an oocyte injection model. Antisense oligonucleotides 25 nucleobases in length with 8 or 11 mismatch bases near the ends of the antisense oligonucleotides were able to direct specific cleavage of the target mRNA, albeit to a lesser extent than the antisense oligonucleotides that contained no mismatches. Similarly, target specific cleavage was achieved using 13 nucleobase antisense oligonucleotides, including those with 1 or 3 mismatches.

Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo.

Maher and Dolnick (Nuc. Acid. Res. 16:3341-3358, 1988) tested a series of tandem 14 nucleobase antisense oligonucleotides, and a 28 and 42 nucleobase antisense oligonucleotides comprised of the sequence of two or three of the tandem antisense oligonucleotides, respectively, for their ability to arrest translation of human DHFR in a rabbit reticulocyte assay. Each of the three 14 nucleobase antisense oligonucleotides alone was able to inhibit translation, albeit at a more modest level than the 28 or 42 nucleobase antisense oligonucleotides.

Antisense Compound Motifs

In certain embodiments, antisense compounds targeted to a Tau nucleic acid have chemically modified subunits arranged in patterns, or motifs, to confer to the antisense compounds properties such as enhanced inhibitory activity, increased binding affinity for a target nucleic acid, or resistance to degradation by in vivo nucleases.

Chimeric antisense compounds typically contain at least one region modified so as to confer increased resistance to nuclease degradation, increased cellular uptake, increased binding affinity for the target nucleic acid, and/or increased inhibitory activity. A second region of a chimeric antisense compound may optionally serve as a substrate for the cellular endonuclease RNase H, which cleaves the RNA strand of an RNA:DNA duplex.

Antisense compounds having a gapmer motif are considered chimeric antisense compounds. In a gapmer an internal region having a plurality of nucleotides that supports RNaseH cleavage is positioned between external regions having a plurality of nucleotides that are chemically distinct from the nucleosides of the internal region. In the case of an antisense oligonucleotide having a gapmer motif, the gap segment generally serves as the substrate for endonuclease cleavage, while the wing segments comprise modified nucleosides. In certain embodiments, the regions of a gapmer are differentiated by the types of sugar moieties comprising each distinct region. The types of sugar moieties that are used to differentiate the regions of a gapmer may in some embodiments include β-D-ribonucleosides, β-D-deoxyribonucleosides, 2'-modified nucleosides (such 2'-modified nucleosides may include 2'-MOE, and 2'-O—CH$_3$, among others), and bicyclic sugar modified nucleosides (such bicyclic sugar modified nucleosides may include those having a 4'-(CH$_2$)n-O-2' bridge, where n=1 or n=2 and 4'-CH$_2$—O—CH$_2$-2'). In certain embodiments, wings may include several modified sugar moieties, including, for example 2'-MOE. In certain embodiments, wings may include several modified and unmodified sugar moieties. In certain embodiments, wings may include various combinations of 2'-MOE nucleosides and 2'-deoxynucleosides.

Each distinct region may comprise uniform sugar moieties, variant, or alternating sugar moieties. The wing-gap-wing motif is frequently described as "X—Y—Z", where "X" represents the length of the 5' wing, "Y" represents the length of the gap, and "Z" represents the length of the 3' wing. "X" and "Z" may comprise uniform, variant, or alternating sugar moieties. In certain embodiments, "X" and "Y" may include one or more 2'-deoxynucleosides. "Y" may comprise 2'-deoxynucleosides. As used herein, a gapmer described as "X—Y—Z" has a configuration such that the gap is positioned immediately adjacent to each of the 5' wing and the 3' wing. Thus, no intervening nucleotides exist between the 5' wing and gap, or the gap and the 3' wing. Any of the antisense compounds described herein can have a gapmer motif. In certain embodiments, "X" and "Z" are the same; in other embodiments they are different.

In certain embodiments, gapmers provided herein include, for example 20-mers having a motif of 5-10-5.

In certain embodiments, gapmers provided herein include, for example 19-mers having a motif of 5-9-5.

In certain embodiments, gapmers provided herein include, for example 18-mers having a motif of 5-8-5.

In certain embodiments, gapmers provided herein include, for example 18-mers having a motif of 4-8-6.

In certain embodiments, gapmers provided herein include, for example 18-mers having a motif of 6-8-4.

In certain embodiments, gapmers provided herein include, for example 18-mers having a motif of 5-7-6.

Target Nucleic Acids, Target Regions and Nucleotide Sequences

Nucleotide sequences that encode Tau include, without limitation, the following: GENBANK Accession No. NT_010783.15 truncated from nucleotides 9240000 to U.S. Pat. No. 9,381,000 (incorporated herein as SEQ ID NO: 1), GENBANK Accession No. NM_001123066.3 (incorporated herein as SEQ ID NO: 2), GENBANK Accession No. NM_016841.4, a variant mRNA sequence which skips exons 3, 4, 6, 8, 10, and 12 (incorporated herein as SEQ ID NO: 3), GENBANK Accession No. NT_010783.14 truncated from nucleotides 2624000 to U.S. Pat. No. 2,761,000 (incorporated herein as SEQ ID NO: 4), GENBANK Accession No. DR002467.1 (incorporated herein as SEQ ID NO: 5), GENBANK Accession No. NM_001203251.1 (incorporated herein as SEQ ID NO: 6), and GENBANK Accession No. NM_016835.4 (incorporated herein as SEQ ID NO: 7).

It is understood that the sequence set forth in each SEQ ID NO in the Examples contained herein is independent of any modification to a sugar moiety, an internucleoside linkage, or a nucleobase. As such, antisense compounds defined by a SEQ ID NO may comprise, independently, one or more modifications to a sugar moiety, an internucleoside linkage, or a nucleobase. Antisense compounds described by Isis Number (Isis No) indicate a combination of nucleobase sequence and motif.

In certain embodiments, a target region is a structurally defined region of the target nucleic acid. For example, a target region may encompass a 3' UTR, a 5' UTR, an exon, an intron, an exon/intron junction, a coding region, a translation initiation region, translation termination region, or other defined nucleic acid region. The structurally defined regions for Tau can be obtained by accession number from sequence databases such as NCBI and such information is incorporated herein by reference. In certain embodiments, a target region may encompass the sequence from a 5' target site of one target segment within the target region to a 3' target site of another target segment within the same target region.

Targeting includes determination of at least one target segment to which an antisense compound hybridizes, such that a desired effect occurs. In certain embodiments, the desired effect is a reduction in mRNA target nucleic acid levels. In certain embodiments, the desired effect is reduction of levels of protein encoded by the target nucleic acid or a phenotypic change associated with the target nucleic acid.

A target region may contain one or more target segments. Multiple target segments within a target region may be overlapping. Alternatively, they may be non-overlapping. In certain embodiments, target segments within a target region are separated by no more than about 300 nucleotides. In certain embodiments, target segments within a target region are separated by a number of nucleotides that is, is about, is no more than, is no more than about, 250, 200, 150, 100, 90, 80, 70, 60, 50, 40, 30, 20, or 10 nucleotides on the target nucleic acid, or is a range defined by any two of the preceeding values. In certain embodiments, target segments within a target region are separated by no more than, or no more than about, 5 nucleotides on the target nucleic acid. In certain embodiments, target segments are contiguous. Contemplated are target regions defined by a range having a starting nucleic acid that is any of the 5' target sites or 3' target sites listed herein.

Suitable target segments may be found within a 5' UTR, a coding region, a 3' UTR, an intron, an exon, or an exon/intron junction. Target segments containing a start codon or a stop codon are also suitable target segments. A suitable target segment may specifically exclude a certain structurally defined region such as the start codon or stop codon.

The determination of suitable target segments may include a comparison of the sequence of a target nucleic acid to other sequences throughout the genome. For example, the BLAST algorithm may be used to identify regions of similarity amongst different nucleic acids. This comparison can prevent the selection of antisense compound sequences that may hybridize in a non-specific manner to sequences other than a selected target nucleic acid (i.e., non-target or off-target sequences).

There may be variation in activity (e.g., as defined by percent reduction of target nucleic acid levels) of the antisense compounds within an active target region. In certain embodiments, reductions in Tau mRNA levels are indicative of inhibition of Tau expression. Reductions in levels of a Tau protein are also indicative of inhibition of target mRNA expression. Reduction of percent of cells staining positive for hyperphosphorylated Tau are indicative of inhibition of Tau expression. Further, phenotypic changes are indicative of inhibition of Tau expression. Improvement in neurological function is indicative of inhibition of Tau expression. Improved memory and motor function are indicative of inhibition of Tau expression. Reduction of neurofibrillary inclusions is indicative of inhibition of Tau expression.

Hybridization

In some embodiments, hybridization occurs between an antisense compound disclosed herein and a Tau nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Stringent conditions are sequence-dependent and are determined by the nature and composition of the nucleic acid molecules to be hybridized.

Methods of determining whether a sequence is specifically hybridizable to a target nucleic acid are well known in the art. In certain embodiments, the antisense compounds provided herein are specifically hybridizable with a Tau nucleic acid.

Complementarity

An antisense compound and a target nucleic acid are complementary to each other when a sufficient number of nucleobases of the antisense compound can hydrogen bond with the corresponding nucleobases of the target nucleic acid, such that a desired effect will occur (e.g., antisense inhibition of a target nucleic acid, such as a Tau nucleic acid).

Non-complementary nucleobases between an antisense compound and a Tau nucleic acid may be tolerated provided that the antisense compound remains able to specifically hybridize to a target nucleic acid. Moreover, an antisense compound may hybridize over one or more segments of a Tau nucleic acid such that intervening or adjacent segments are not involved in the hybridization event (e.g., a loop structure, mismatch or hairpin structure).

In certain embodiments, the antisense compounds provided herein, or a specified portion thereof, are, or are at least, 70%, 80%, 85%, 86%, 87%, 88%, 89%, 90%, 91%, 92%, 93%, 94%, 95%, 96%, 97%, 98%, 99%, or 100% complementary to a Tau nucleic acid, a target region, target segment, or specified portion thereof. Percent complementarity of an antisense compound with a target nucleic acid can be determined using routine methods.

For example, an antisense compound in which 18 of 20 nucleobases of the antisense compound are complementary to a target region, and would therefore specifically hybridize, would represent 90 percent complementarity. In this example, the remaining noncomplementary nucleobases may be clustered or interspersed with complementary nucleobases and need not be contiguous to each other or to complementary nucleobases. As such, an antisense compound which is 18 nucleobases in length having 4 (four) noncomplementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., J. Mol. Biol., 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, the antisense compounds provided herein, or specified portions thereof, are fully complementary (i.e., 100% complementary) to a target nucleic acid, or specified portion thereof. For example, an antisense compound may be fully complementary to a Tau nucleic acid, or a target region, or a target segment or target sequence thereof. As used herein, "fully complementary" means each nucleobase of an antisense compound is capable of precise base pairing with the corresponding nucleobases of a target nucleic acid. For example, a 20 nucleobase antisense compound is fully complementary to a target sequence that is 400 nucleobases long, so long as there is a corresponding 20 nucleobase portion of the target nucleic acid that is fully complementary to the antisense compound. Fully complementary can also be used in reference to a specified portion of the first and/or the second nucleic acid. For example, a 20 nucleobase portion of a 30 nucleobase antisense compound can be "fully complementary" to a target sequence that is 400 nucleobases long. The 20 nucleobase portion of the 30 nucleobase oligonucleotide is fully complementary to the target sequence if the target sequence has a corresponding 20 nucleobase portion wherein each nucleobase is complementary to the 20 nucleobase portion of the antisense compound. At the same time, the entire 30 nucleobase antisense compound may or may not be fully complementary to the target sequence, depending on whether the remaining 10 nucleobases of the antisense compound are also complementary to the target sequence.

The location of a non-complementary nucleobase may be at the 5' end or 3' end of the antisense compound. Alternatively, the non-complementary nucleobase or nucleobases may be at an internal position of the antisense compound. When two or more non-complementary nucleobases are present, they may be contiguous (i.e., linked) or non-contiguous. In one embodiment, a non-complementary nucleobase is located in the wing segment of a gapmer antisense oligonucleotide.

In certain embodiments, antisense compounds that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a Tau nucleic acid, or specified portion thereof In certain embodiments, antisense compounds that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a Tau nucleic acid, or specified portion thereof The antisense compounds provided herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of an antisense compound. In certain embodiments, the antisense compounds, are complementary to at least an 8 nucleobase portion of a target segment. In certain embodiments, the antisense compounds are complementary to at least a 9 nucleobase portion of a target segment. In certain embodiments, the antisense compounds are complementary to at least a 10 nucleobase portion of a target segment. In certain embodiments, the antisense compounds, are complementary to at least an 11 nucleobase portion of a target segment. In certain embodiments, the antisense compounds, are complementary to at least a 12 nucleobase portion of a target segment. In certain embodiments, the antisense compounds, are complementary to at least a 13 nucleobase portion of a target segment. In certain embodiments, the antisense compounds, are complementary to at least a 14 nucleobase portion of a target segment. In certain embodiments, the antisense compounds, are complementary to at least a 15 nucleobase portion of a target segment. Also contemplated are antisense compounds that are complementary to at least a 9, 10, 11, 12, 13, 14, 15, 16, 17, 18, 19, 20, or more nucleobase portion of a target segment, or a range defined by any two of these values.

Identity

The antisense compounds provided herein may also have a defined percent identity to a particular nucleotide sequence, SEQ ID NO, or compound represented by a specific Isis number, or portion thereof. As used herein, an antisense compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the antisense compounds described herein as well as compounds having non-identical bases relative to the antisense compounds provided herein also are contemplated. The non-identical bases may be adjacent to each other or dispersed throughout the antisense compound. Percent identity of an antisense compound is calculated according to the number of bases that have identical base pairing relative to the sequence to which it is being compared.

In certain embodiments, the antisense compounds, or portions thereof, are at least 70%, 75%, 80%, 85%, 90%, 95%, 96%, 97%, 98%, 99% or 100% identical to one or more of the antisense compounds or SEQ ID NOs, or a portion thereof, disclosed herein.

In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, a portion of the antisense oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Modifications

A nucleoside is a base-sugar combination. The nucleobase (also known as base) portion of the nucleoside is normally a heterocyclic base moiety. Nucleotides are nucleosides that further include a phosphate group covalently linked to the sugar portion of the nucleoside. For those nucleosides that include a pentofuranosyl sugar, the phosphate group can be linked to the 2', 3' or 5' hydroxyl moiety of the sugar. Oligonucleotides are formed through the covalent linkage of adjacent nucleosides to one another, to form a linear polymeric oligonucleotide. Within the oligonucleotide structure, the phosphate groups are commonly referred to as forming the internucleoside linkages of the oligonucleotide.

Modifications to antisense compounds encompass substitutions or changes to internucleoside linkages, sugar moieties, or nucleobases. Modified antisense compounds are often preferred over native forms because of desirable properties such as, for example, enhanced cellular uptake, enhanced affinity for nucleic acid target, increased stability in the presence of nucleases, or increased inhibitory activity.

Chemically modified nucleosides may also be employed to increase the binding affinity of a shortened or truncated antisense oligonucleotide for its target nucleic acid. Consequently, comparable results can often be obtained with shorter antisense compounds that have such chemically modified nucleosides.

Modified Internucleoside Linkages

The naturally occurring internucleoside linkage of RNA and DNA is a 3' to 5' phosphodiester linkage. Antisense compounds having one or more modified, i.e. non-naturally occurring, internucleoside linkages are often selected over antisense compounds having naturally occurring internucleoside linkages because of desirable properties such as, for example, enhanced cellular uptake, enhanced affinity for target nucleic acids, and increased stability in the presence of nucleases.

Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, antisense compounds targeted to a Tau nucleic acid comprise one or more modified internucleoside linkages. In certain embodiments, the modified internucleoside linkages are interspersed throughout the antisense compound. In certain embodiments, the modified internucleoside linkages are phosphorothioate linkages. In certain embodiments, each internucleoside linkage of an antisense compound is a phosphorothioate internucleoside linkage.

Modified Sugar Moieties

Antisense compounds can optionally contain one or more nucleosides wherein the sugar group has been modified. Such sugar modified nucleosides may impart enhanced nuclease stability, increased binding affinity, or some other beneficial biological property to the antisense compounds. In certain embodiments, nucleosides comprise chemically modified ribofuranose ring moieties. Examples of chemically modified ribofuranose rings include without limitation, addition of substitutent groups (including 5' and 2' substituent groups, bridging of non-geminal ring atoms to form bicyclic nucleic acids (BNA), replacement of the ribosyl ring oxygen atom with S, N(R), or $C(R_1)(R_2)$ (R, $R_1$ and $R_2$ are each independently H, $C_1$-$C_{12}$ alkyl or a protecting group) and combinations thereof. Examples of chemically modified sugars include 2'-F-5'-methyl substituted nucleoside (see PCT International Application WO 2008/101157 Published on Aug. 21, 2008 for other disclosed 5',2'-bis substituted nucleosides) or replacement of the ribosyl ring oxygen atom with S with further substitution at the 2'-position (see published U.S. Patent Application US2005-0130923, published on Jun. 16, 2005) or alternatively 5'-substitution of a BNA (see PCT International Application WO 2007/134181 Published on Nov. 22, 2007 wherein LNA is substituted with for example a 5'-methyl or a 5'-vinyl group).

Examples of nucleosides having modified sugar moieties include without limitation nucleosides comprising 5'-vinyl, 5'-methyl (R or 5), 4'-S, 2'-F, 2'-$OCH_3$, 2'-$OCH_2CH_3$, 2'-$OCH_2CH_2F$ and 2'-$O(CH_2)_2OCH_3$ substituent groups. The substituent at the 2' position can also be selected from allyl, amino, azido, thio, O-allyl, O—$C_1$-$C_{10}$ alkyl, $OCF_3$, $OCH_2F$, $O(CH_2)_2SCH_3$, $O(CH_2)_2$—O—$N(R_m)(R_n)$, O—$CH_2$—C(=O)—$N(R_m)(R_n)$, and O—$CH_2$—C(=O)—$N(R_1)$—$(CH_2)_2$—$N(R_m)(R_n)$, where each $R_l$, $R_m$ and $R_n$ is, independently, H or substituted or unsubstituted $C_1$-$C_{10}$ alkyl.

As used herein, "bicyclic nucleosides" refer to modified nucleosides comprising a bicyclic sugar moiety. Examples of bicyclic nucleosides include without limitation nucleosides comprising a bridge between the 4' and the 2' ribosyl ring atoms. In certain embodiments, antisense compounds provided herein include one or more bicyclic nucleosides comprising a 4' to 2' bridge. Examples of such 4' to 2' bridged bicyclic nucleosides, include but are not limited to one of the formulae: 4'-($CH_2$)—O-2' (LNA); 4'-($CH_2$)—S-2; 4'-($CH_2$)$_2$—O-2' (ENA); 4'-CH($CH_3$)—O-2' and 4'-CH($CH_2OCH_3$)—O-2' (and analogs thereof see U.S. Pat. No. 7,399,845, issued on Jul. 15, 2008); 4'-C($CH_3$)($CH_3$)—O-2' (and analogs thereof see published International Application WO/2009/006478, published Jan. 8, 2009); 4'-$CH_2$—N($OCH_3$)-2' (and analogs thereof see published International Application WO/2008/150729, published Dec. 11, 2008); 4'-$CH_2$—O—N($CH_3$)-2' (see published U.S. Patent Application US2004-0171570, published Sep. 2, 2004); 4'-$CH_2$—N(R)—O-2', wherein R is H, $C_1$-$C_{12}$ alkyl, or a protecting group (see U.S. Pat. No. 7,427,672, issued on Sep. 23, 2008); 4'-$CH_2$—C(H)($CH_3$)-2' (see Chattopadhyaya et al., *J. Org. Chem.*, 2009, 74, 118-134); and 4'-$CH_2$—C—(=$CH_2$)-2' (and analogs thereof see published International Application WO 2008/154401, published on Dec. 8, 2008).

Further reports related to bicyclic nucleosides can also be found in published literature (see for example: Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129(26) 8362-8379; Elayadi et al., *Curr. Opinion Invest. Drugs*, 2001, 2, 558-561; Braasch et al., *Chem. Biol.*, 2001, 8, 1-7; and Orum et al., *Curr. Opinion Mol. Ther.*, 2001, 3, 239-243; U.S. Pat. Nos. 6,268,490; 6,525,191; 6,670,461; 6,770,748; 6,794,499; 7,034,133; 7,053,207; 7,399,845; 7,547,684; and 7,696,345; U.S. Patent Publication No. US2008-0039618; US2009-0012281; U.S. Patent Serial Nos. 60/989,574; 61/026,995; 61/026,998; 61/056,564; 61/086,231; 61/097,787; and 61/099,844; Published PCT International applications WO 1994/014226; WO 2004/106356; WO 2005/021570; WO 2007/134181; WO 2008/150729; WO 2008/154401; and WO 2009/006478. Each of the foregoing bicyclic nucleosides can be prepared having one or more stereochemical sugar configurations including for example α-L-ribofuranose and β-D-ribofuranose (see PCT international application PCT/DK98/00393, published on Mar. 25, 1999 as WO 99/14226).

In certain embodiments, bicyclic sugar moieties of BNA nucleosides include, but are not limited to, compounds having at least one bridge between the 4' and the 2' position of the pentofuranosyl sugar moiety wherein such bridges independently comprises 1 or from 2 to 4 linked groups independently selected from —[$C(R_a)(R_b)]_n$—, —$C(R_a)$ =$C(R_b)$—, —$C(R_a)$=N—, —C(=O)—, —C(=$NR_a$)—, —C(=S)—, —O—, —Si($R_a)_2$—, —S(=O)$_x$—, and —N($R_a$)—;

wherein:

x is 0, 1, or 2;

n is 1, 2, 3, or 4;

each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, $OJ_1$, $NJ_1J_2$, $SJ_1$, $N_3$, $COOJ_1$, acyl (C(=O)—H), substituted acyl, CN, sulfonyl (S(=O)$_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl or a protecting group.

In certain embodiments, the bridge of a bicyclic sugar moiety is —[C($R_a$)($R_b$)]$_n$—, —[C($R_a$)($R_b$)]$_n$—O—, —C($R_a R_b$)—N(R)—O— or —C($R_a R_b$)—O—N(R)—. In certain embodiments, the bridge is 4'-$CH_2$-2', 4'-($CH_2$)$_2$-2', 4'-($CH_2$)$_3$-2', 4'-$CH_2$—O-2', 4'-($CH_2$)$_2$—O-2', 4'-$CH_2$—O—N(R)-2' and 4'-$CH_2$—N(R)—O-2'- wherein each R is, independently, H, a protecting group or $C_1$-$C_{12}$ alkyl.

In certain embodiments, bicyclic nucleosides are further defined by isomeric configuration. For example, a nucleoside comprising a 4'-2' methylene-oxy bridge, may be in the α-L configuration or in the β-D configuration. Previously, α-L-methyleneoxy (4'-$CH_2$—O-2') BNA's have been incorporated into antisense oligonucleotides that showed antisense activity (Frieden et al., *Nucleic Acids Research*, 2003, 21, 6365-6372).

In certain embodiments, bicyclic nucleosides include, but are not limited to, (A) α-L-methyleneoxy (4'-$CH_2$—O-2') BNA, (B) β-D-methyleneoxy (4'-$CH_2$—O-2') BNA, (C) ethyleneoxy (4'-($CH_2$)$_2$—O-2') BNA, (D) aminooxy (4'-$CH_2$—O—N(R)-2') BNA, (E) oxyamino (4'-$CH_2$—N(R)—O-2') BNA, and (F) methyl(methyleneoxy) (4'-CH($CH_3$)—O-2') BNA, (G) methylene-thio (4'-$CH_2$—S-2') BNA, (H) methylene-amino (4'-$CH_2$—N(R)-2') BNA, (I) methyl carbocyclic (4'-$CH_2$—CH($CH_3$)-2') BNA, and (J) propylene carbocyclic (4'-($CH_2$)$_3$-2') BNA as depicted below.

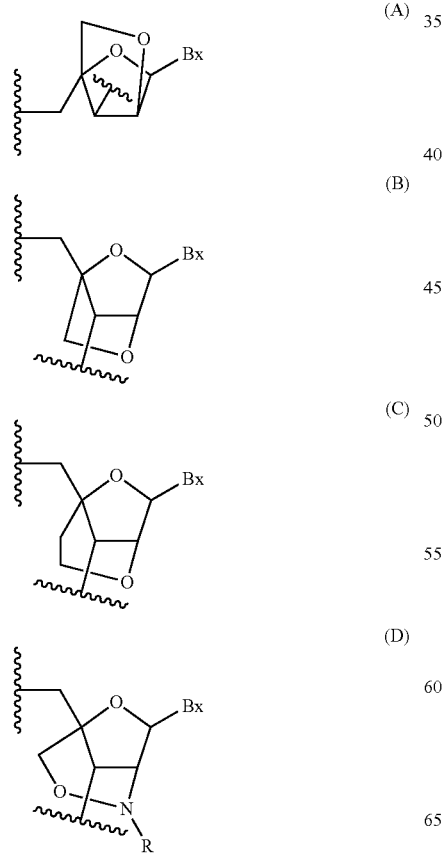

(A)

(B)

(C)

(D)

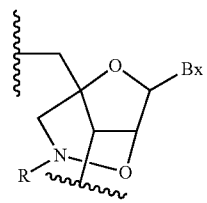

(E)

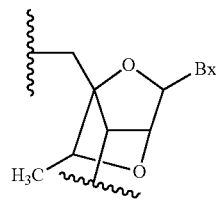

(F)

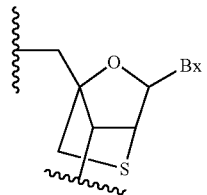

(G)

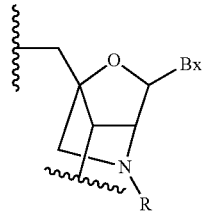

(H)

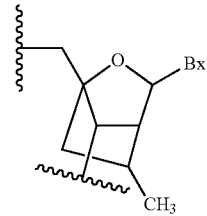

(I)

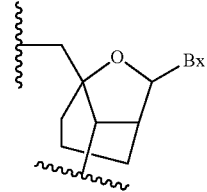

(J)

wherein Bx is the base moiety and R is independently H, a protecting group or $C_1$-$C_{12}$ alkyl.

In certain embodiments, bicyclic nucleosides are provided having Formula I:

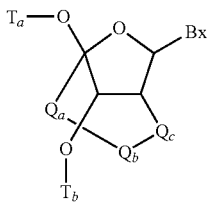

I wherein:
Bx is a heterocyclic base moiety;
-$Q_a$-$Q_b$-$Q_c$- is —$CH_2$—N($R_c$)—$CH_2$—, —C(=O)—N($R_c$)—$CH_2$—, —$CH_2$—O—N($R_c$)—, —$CH_2$—N($R_c$)—O— or —N($R_c$)—O—$CH_2$;
$R_c$ is $C_1$-$C_{12}$ alkyl or an amino protecting group; and
$T_a$ and $T_b$ are each, independently H, a hydroxyl protecting group, a conjugate group, a reactive phosphorus group, a phosphorus moiety or a covalent attachment to a support medium.

In certain embodiments, bicyclic nucleosides are provided having Formula II:

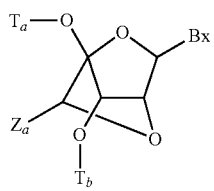

II wherein:
Bx is a heterocyclic base moiety;
$T_a$ and $T_b$ are each, independently H, a hydroxyl protecting group, a conjugate group, a reactive phosphorus group, a phosphorus moiety or a covalent attachment to a support medium;
$Z_a$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, substituted amide, thiol or substituted thio.

In one embodiment, each of the substituted groups is, independently, mono or poly substituted with substituent groups independently selected from halogen, oxo, hydroxyl, $OJ_c$, $NJ_cJ_d$, $SJ_c$, $N_3$, OC(=X)$J_c$, and $NJ_cC$(=X)$NJ_cJ_d$, wherein each $J_c$, $J_d$ and $J_e$ is, independently, H, $C_1$-$C_6$ alkyl, or substituted $C_1$-$C_6$ alkyl and X is O or $NJ_c$.

In certain embodiments, bicyclic nucleosides are provided having Formula III:

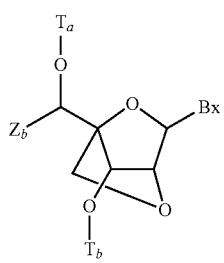

III wherein:
Bx is a heterocyclic base moiety;
$T_a$ and $T_b$ are each, independently H, a hydroxyl protecting group, a conjugate group, a reactive phosphorus group, a phosphorus moiety or a covalent attachment to a support medium;
$Z_b$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl or substituted acyl (C(=O)—).

In certain embodiments, bicyclic nucleosides are provided having Formula IV:

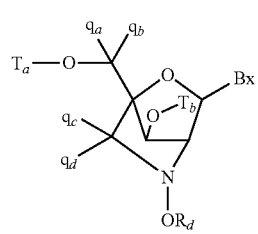

IV wherein:
Bx is a heterocyclic base moiety;
$T_a$ and $T_b$ are each, independently H, a hydroxyl protecting group, a conjugate group, a reactive phosphorus group, a phosphorus moiety or a covalent attachment to a support medium;
$R_d$ is $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl;
each $q_a$, $q_b$, $q_c$ and $q_d$ is, independently, H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl, $C_1$-$C_6$ alkoxyl, substituted $C_1$-$C_6$ alkoxyl, acyl, substituted acyl, $C_1$-$C_6$ aminoalkyl or substituted $C_1$-$C_6$ aminoalkyl;

In certain embodiments, bicyclic nucleosides are provided having Formula V:

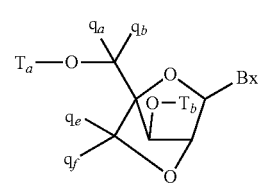

V wherein:
Bx is a heterocyclic base moiety;
$T_a$ and $T_b$ are each, independently H, a hydroxyl protecting group, a conjugate group, a reactive phosphorus group, a phosphorus moiety or a covalent attachment to a support medium;
$q_a$, $q_b$, $q_e$ and $q_f$ are each, independently, hydrogen, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxy, substituted $C_1$-$C_{12}$ alkoxy, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$ or N(H)C(=S)$NJ_jJ_k$;
or $q_e$ and $q_f$ together are =C($q_g$)($q_h$);
$q_g$ and $q_h$ are each, independently, H, halogen, $C_1$-$C_{12}$ alkyl or substituted $C_1$-$C_{12}$ alkyl.

The synthesis and preparation of the methyleneoxy (4'-$CH_2$—O-2') BNA monomers adenine, cytosine, guanine, 5-methyl-cytosine, thymine and uracil, along with their oligomerization, and nucleic acid recognition properties have been described (Koshkin et al., *Tetrahedron*, 1998, 54, 3607-3630). BNAs and preparation thereof are also described in WO 98/39352 and WO 99/14226.

Analogs of methyleneoxy (4'-CH$_2$—O-2') BNA and 2'-thio-BNAs, have also been prepared (Kumar et al., *Bioorg. Med. Chem. Lett.*, 1998, 8, 2219-2222). Preparation of locked nucleoside analogs comprising oligodeoxyribonucleotide duplexes as substrates for nucleic acid polymerases has also been described (Wengel et al., WO 99/14226). Furthermore, synthesis of 2'-amino-BNA, a novel comformationally restricted high-affinity oligonucleotide analog has been described in the art (Singh et al., *J. Org. Chem.*, 1998, 63, 10035-10039). In addition, 2'-amino- and 2'-methylamino-BNA's have been prepared and the thermal stability of their duplexes with complementary RNA and DNA strands has been previously reported.

In certain embodiments, bicyclic nucleosides are provided having Formula VI:

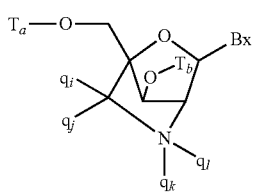

VI wherein:
Bx is a heterocyclic base moiety;
T$_a$ and T$_b$ are each, independently, H, a hydroxyl protecting group, a conjugate group, a reactive phosphorus group, a phosphorus moiety or a covalent attachment to a support medium;
each q$_i$, q$_j$, q$_k$ and q$_l$ is, independently, H, halogen, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_1$-C$_{12}$ alkoxyl, substituted C$_1$-C$_{12}$ alkoxyl, OJ$_j$, SJ$_j$, SOJ$_j$, SO$_2$J$_j$, NJ$_j$J$_k$, N$_3$, CN, C(=O)OJ$_j$, C(=O)NJ$_j$J$_k$, C(=O)J$_j$, O—C(=O)NJ$_j$J$_k$, N(H)C(=NH)NJ$_j$J$_k$, N(H)C(=O)NJ$_j$J$_k$ or N(H)C(=S)NJ$_j$J$_k$; and
q$_i$ and q$_j$ or q$_l$ and q$_k$ together are =C(q$_g$)(q$_h$), wherein q$_g$ and q$_h$ are each, independently, H, halogen, C$_1$-C$_{12}$ alkyl or substituted C$_1$-C$_{12}$ alkyl.

One carbocyclic bicyclic nucleoside having a 4'-(CH$_2$)$_3$-2' bridge and the alkenyl analog bridge 4'-CH=CH—CH$_2$-2' have been described (Freier et al., *Nucleic Acids Research*, 1997, 25(22), 4429-4443 and Albaek et al., *J. Org. Chem.*, 2006, 71, 7731-7740). The synthesis and preparation of carbocyclic bicyclic nucleosides along with their oligomerization and biochemical studies have also been described (Srivastava et al., *J. Am. Chem. Soc.*, 2007, 129(26), 8362-8379).

As used herein, "4'-2' bicyclic nucleoside" or "4' to 2' bicyclic nucleoside" refers to a bicyclic nucleoside comprising a furanose ring comprising a bridge connecting two carbon atoms of the furanose ring connects the 2' carbon atom and the 4' carbon atom of the sugar ring.

As used herein, "monocylic nucleosides" refer to nucleosides comprising modified sugar moieties that are not bicyclic sugar moieties. In certain embodiments, the sugar moiety, or sugar moiety analogue, of a nucleoside may be modified or substituted at any position.

As used herein, "2'-modified sugar" means a furanosyl sugar modified at the 2' position. In certain embodiments, such modifications include substituents selected from: a halide, including, but not limited to substituted and unsubstituted alkoxy, substituted and unsubstituted thioalkyl, substituted and unsubstituted amino alkyl, substituted and unsubstituted alkyl, substituted and unsubstituted allyl, and substituted and unsubstituted alkynyl. In certain embodiments, 2' modifications are selected from substituents including, but not limited to: O[(CH$_2$)$_n$O]$_m$CH$_3$, O(CH$_2$)$_n$NH$_2$, O(CH$_2$)$_n$CH$_3$, O(CH$_2$)$_n$F, O(CH$_2$)—ONH$_2$, OCH$_2$C(=O)N(H)CH$_3$, and O(CH$_2$)$_n$ON[(CH$_2$)$_n$CH$_3$]$_2$, where n and m are from 1 to about 10. Other 2'-substituent groups can also be selected from: C$_1$-C$_{12}$ alkyl, substituted alkyl, alkenyl, alkynyl, alkaryl, aralkyl, O-alkaryl or O-aralkyl, SH, SCH$_3$, OCN, Cl, Br, CN, F, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving pharmacokinetic properties, or a group for improving the pharmacodynamic properties of an antisense compound, and other substituents having similar properties. In certain embodiments, modified nucleosides comprise a 2'-MOE side chain (Baker et al., *J. Biol. Chem.*, 1997, 272, 11944-12000). Such 2'-MOE substitution have been described as having improved binding affinity compared to unmodified nucleosides and to other modified nucleosides, such as 2'-O-methyl, O-propyl, and O-aminopropyl. Oligonucleotides having the 2'-MOE substituent also have been shown to be antisense inhibitors of gene expression with promising features for in vivo use (Martin, *Helv. Chim. Acta*, 1995, 78, 486-504; Altmann et al., *Chimia*, 1996, 50, 168-176; Altmann et al., *Biochem. Soc. Trans.*, 1996, 24, 630-637; and Altmann et al., *Nucleosides Nucleotides*, 1997, 16, 917-926).

As used herein, a "modified tetrahydropyran nucleoside" or "modified THP nucleoside" means a nucleoside having a six-membered tetrahydropyran "sugar" substituted in for the pentofuranosyl residue in normal nucleosides (a sugar surrogate). Modified THP nucleosides include, but are not limited to, what is referred to in the art as hexitol nucleic acid (HNA), anitol nucleic acid (ANA), manitol nucleic acid (MNA) (see Leumann, *Bioorg. Med. Chem.*, 2002, 10, 841-854), fluoro HNA (F-HNA) or those compounds having Formula VII:

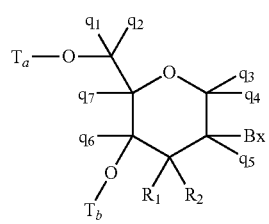

VII wherein independently for each of said at least one tetrahydropyran nucleoside analog of Formula VII:
Bx is a heterocyclic base moiety;
T$_a$ and T$_b$ are each, independently, an internucleoside linking group linking the tetrahydropyran nucleoside analog to the antisense compound or one of T$_a$ and T$_b$ is an internucleoside linking group linking the tetrahydropyran nucleoside analog to the antisense compound and the other of $T_a$ and $T_b$ is H, a hydroxyl protecting group, a linked conjugate group or a 5' or 3'-terminal group;

$q_1$, $q_2$, $q_3$, $q_4$, $q_5$, $q_6$ and $q_7$ are each independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl; and each of $R_1$ and $R_2$ is selected from hydrogen, hydroxyl, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$ and CN, wherein X is O, S or $NJ_1$ and each $J_1$, $J_2$ and $J_3$ is, independently, H or $C_1$-$C_6$ alkyl.

In certain embodiments, the modified THP nucleosides of Formula VII are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, THP nucleosides of Formula VII are provided wherein one of $R_1$ and $R_2$ is fluoro. In certain embodiments, $R_1$ is fluoro and $R_2$ is H; $R_1$ is methoxy and $R_2$ is H, and $R_1$ is H and $R_2$ is methoxyethoxy.

As used herein, "2'-modified" or "2'-substituted" refers to a nucleoside comprising a sugar comprising a substituent at the 2' position other than H or OH. 2'-modified nucleosides, include, but are not limited to, bicyclic nucleosides wherein the bridge connecting two carbon atoms of the sugar ring connects the 2' carbon and another carbon of the sugar ring; and nucleosides with non-bridging 2' substituents, such as allyl, amino, azido, thio, O-allyl, O—$C_1$-$C_{10}$ alkyl, —$OCF_3$, O—$(CH_2)_2$—O—$CH_3$, 2'-O$(CH_2)_2SCH_3$, O—$(CH_2)_2$—O—$N(R_m)(R_n)$, or O—$CH_2$—C(=O)—$N(R_m)(R_n)$, where each $R_m$ and $R_n$ is, independently, H or substituted or unsubstituted $C_1$-$C_{10}$ alkyl. 2'-modifed nucleosides may further comprise other modifications, for example at other positions of the sugar and/or at the nucleobase.

As used herein, "2'-F" refers to a nucleoside comprising a sugar comprising a fluoro group at the 2' position.

As used herein, "2'-OMe" or "2'-$OCH_3$" or "2'-O-methyl" each refers to a nucleoside comprising a sugar comprising an —$OCH_3$ group at the 2' position of the sugar ring.

As used herein, "MOE" or "2'-MOE" or "2'-$OCH_2CH_2OCH_3$" or "2'-O-methoxyethyl" each refers to a nucleoside comprising a sugar comprising a —$OCH_2CH_2OCH_3$ group at the 2' position of the sugar ring.

As used herein, "oligonucleotide" refers to a compound comprising a plurality of linked nucleosides. In certain embodiments, one or more of the plurality of nucleosides is modified. In certain embodiments, an oligonucleotide comprises one or more ribonucleosides (RNA) and/or deoxyribonucleosides (DNA).

Many other bicyclo and tricyclo sugar surrogate ring systems are also known in the art that can be used to modify nucleosides for incorporation into antisense compounds (see for example review article: Leumann, *Bioorg. Med. Chem.*, 2002, 10, 841-854).

Such ring systems can undergo various additional substitutions to enhance activity.

Methods for the preparations of modified sugars are well known to those skilled in the art.

In nucleotides having modified sugar moieties, the nucleobase moieties (natural, modified or a combination thereof) are maintained for hybridization with an appropriate nucleic acid target.

In certain embodiments, antisense compounds comprise one or more nucleosides having modified sugar moieties. In certain embodiments, the modified sugar moiety is 2'-MOE. In certain embodiments, the 2'-MOE modified nucleosides are arranged in a gapmer motif. In certain embodiments, the modified sugar moiety is a bicyclic nucleoside having a (4'-CH(CH$_3$)—O-2') bridging group. In certain embodiments, the (4'-CH(CH$_3$)—O-2') modified nucleosides are arranged throughout the wings of a gapmer motif Compositions and Methods for Formulating Pharmaceutical Compositions Antisense oligonucleotides may be admixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

An antisense compound targeted to a Tau nucleic acid can be utilized in pharmaceutical compositions by combining the antisense compound with a suitable pharmaceutically acceptable diluent or carrier. A pharmaceutically acceptable diluent includes phosphate-buffered saline (PBS). PBS is a diluent suitable for use in compositions to be delivered parenterally. Accordingly, in one embodiment, employed in the methods described herein is a pharmaceutical composition comprising an antisense compound targeted to a Tau nucleic acid and a pharmaceutically acceptable diluent. In certain embodiments, the pharmaceutically acceptable diluent is PBS. In certain embodiments, the antisense compound is an antisense oligonucleotide.

Pharmaceutical compositions comprising antisense compounds encompass any pharmaceutically acceptable salts, esters, or salts of such esters, or any other oligonucleotide which, upon administration to an animal, including a human, is capable of providing (directly or indirectly) the biologically active metabolite or residue thereof. Accordingly, for example, the disclosure is also drawn to pharmaceutically acceptable salts of antisense compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of an antisense compound which are cleaved by endogenous nucleases within the body, to form the active antisense compound.

Conjugated Antisense Compounds

Antisense compounds may be covalently linked to one or more moieties or conjugates which enhance the activity, cellular distribution or cellular uptake of the resulting antisense oligonucleotides. Typical conjugate groups include cholesterol moieties and lipid moieties. Additional conjugate groups include carbohydrates, phospholipids, biotin, phenazine, folate, phenanthridine, anthraquinone, acridine, fluoresceins, rhodamines, coumarins, and dyes.

Antisense compounds can also be modified to have one or more stabilizing groups that are generally attached to one or both termini of antisense compounds to enhance properties such as, for example, nuclease stability. Included in stabilizing groups are cap structures. These terminal modifications protect the antisense compound having terminal nucleic acid from exonuclease degradation, and can help in delivery and/or localization within a cell. The cap can be present at the 5'-terminus (5'-cap), or at the 3'-terminus (3'-cap), or can be present on both termini. Cap structures are well known in the art and include, for example, inverted deoxy abasic caps. Further 3' and 5'-stabilizing groups that can be used to cap one or both ends of an antisense compound to impart nuclease stability include those disclosed in WO 03/004602 published on Jan. 16, 2003.

Cell Culture and Antisense Compounds Treatment

The effects of antisense compounds on the level, activity or expression of Tau nucleic acids can be tested in vitro in a variety of cell types. Cell types used for such analyses are available from commercial vendors (e.g. American Type Culture Collection, Manassas, Va.; Zen-Bio, Inc., Research Triangle Park, N.C.; Clonetics Corporation, Walkersville, Md.) and are cultured according to the vendor's instructions using commercially available reagents (e.g. Invitrogen Life Technologies, Carlsbad, Calif.). Illustrative cell types include, but are not limited to, HepG2 cells, Hep3B cells, and primary hepatocytes.

In Vitro Testing of Antisense Oligonucleotides

Described herein are methods for treatment of cells with antisense oligonucleotides, which can be modified appropriately for treatment with other antisense compounds.

Cells may be treated with antisense oligonucleotides when the cells reach approximately 60-80% confluency in culture.

One reagent commonly used to introduce antisense oligonucleotides into cultured cells includes the cationic lipid transfection reagent LIPOFECTIN (Invitrogen, Carlsbad, Calif.). Antisense oligonucleotides may be mixed with LIPOFECTIN in OPTI-MEM 1 (Invitrogen, Carlsbad, Calif.) to achieve the desired final concentration of antisense oligonucleotide and a LIPOFECTIN concentration that may range from 2 to 12 ug/mL per 100 nM antisense oligonucleotide.

Another reagent used to introduce antisense oligonucleotides into cultured cells includes LIPOFECTAMINE (Invitrogen, Carlsbad, Calif.). Antisense oligonucleotide is mixed with LIPOFECTAMINE in OPTI-MEM 1 reduced serum medium (Invitrogen, Carlsbad, Calif.) to achieve the desired concentration of antisense oligonucleotide and a LIPOFECTAMINE concentration that may range from 2 to 12 ug/mL per 100 nM antisense oligonucleotide.

Another technique used to introduce antisense oligonucleotides into cultured cells includes electroporation.

Cells are treated with antisense oligonucleotides by routine methods. Cells may be harvested 16-24 hours after antisense oligonucleotide treatment, at which time RNA or protein levels of target nucleic acids are measured by methods known in the art and described herein. In general, when treatments are performed in multiple replicates, the data are presented as the average of the replicate treatments.

The concentration of antisense oligonucleotide used varies from cell line to cell line. Methods to determine the optimal antisense oligonucleotide concentration for a particular cell line are well known in the art. Antisense oligonucleotides are typically used at concentrations ranging from 1 nM to 300 nM when transfected with LIPOFECTAMINE. Antisense oligonucleotides are used at higher concentrations ranging from 625 to 20,000 nM when transfected using electroporation.

RNA Isolation

RNA analysis can be performed on total cellular RNA or poly(A)+ mRNA. Methods of RNA isolation are well known in the art. RNA is prepared using methods well known in the art, for example, using the TRIZOL Reagent (Invitrogen, Carlsbad, Calif.) according to the manufacturer's recommended protocols.

Analysis of Inhibition of Target Levels or Expression

Inhibition of levels or expression of a Tau nucleic acid can be assayed in a variety of ways known in the art. For example, target nucleic acid levels can be quantitated by, e.g., Northern blot analysis, competitive polymerase chain reaction (PCR), or quantitative real-time PCR. RNA analysis can be performed on total cellular RNA or poly(A)+ mRNA. Methods of RNA isolation are well known in the art. Northern blot analysis is also routine in the art. Quantitative real-time PCR can be conveniently accomplished using the commercially available ABI PRISM 7600, 7700, or 7900 Sequence Detection System, available from PE-Applied Biosystems, Foster City, Calif. and used according to manufacturer's instructions.

Quantitative Real-Time PCR Analysis of Target RNA Levels

Quantitation of target RNA levels may be accomplished by quantitative real-time PCR using the ABI PRISM 7600, 7700, or 7900 Sequence Detection System (PE-Applied Biosystems, Foster City, Calif.) according to manufacturer's instructions. Methods of quantitative real-time PCR are well known in the art.

Prior to real-time PCR, the isolated RNA is subjected to a reverse transcriptase (RT) reaction, which produces complementary DNA (cDNA) that is then used as the substrate for the real-time PCR amplification. The RT and real-time PCR reactions are performed sequentially in the same sample well. RT and real-time PCR reagents may be obtained from Invitrogen (Carlsbad, Calif.). RT real-time-PCR reactions are carried out by methods well known to those skilled in the art.

Gene (or RNA) target quantities obtained by real time PCR are normalized using either the expression level of a gene whose expression is constant, such as cyclophilin A, or by quantifying total RNA using RIBOGREEN (Invitrogen, Inc. Carlsbad, Calif.). Cyclophilin A expression is quantified by real time PCR, by being run simultaneously with the target, multiplexing, or separately. Total RNA is quantified using RIBOGREEN RNA quantification reagent (Invetrogen, Inc. Eugene, Oreg.). Methods of RNA quantification by RIBOGREEN are taught in Jones, L. J., et al, (Analytical Biochemistry, 1998, 265, 368-374). A CYTOFLUOR 4000 instrument (PE Applied Biosystems) is used to measure RIBOGREEN fluorescence.

Probes and primers are designed to hybridize to a Tau nucleic acid. Methods for designing real-time PCR probes and primers are well known in the art, and may include the use of software such as PRIMER EXPRESS Software (Applied Biosystems, Foster City, Calif.).

Analysis of Protein Levels

Antisense inhibition of Tau nucleic acids can be assessed by measuring Tau protein levels. Protein levels of Tau can be evaluated or quantitated in a variety of ways well known in the art, such as immunoprecipitation, Western blot analysis (immunoblotting), enzyme-linked immunosorbent assay (ELISA), quantitative protein assays, protein activity assays (for example, caspase activity assays), immunohistochemistry, immunocytochemistry or fluorescence-activated cell sorting (FACS). Antibodies directed to a target can be identified and obtained from a variety of sources, such as the MSRS catalog of antibodies (Aerie Corporation, Birmingham, Mich.), or can be prepared via conventional monoclonal or polyclonal antibody generation methods well known in the art.

In Vivo Testing of Antisense Compounds

Antisense compounds, for example, antisense oligonucleotides, are tested in animals to assess their ability to inhibit expression of Tau and produce phenotypic changes, such as, improved cognition and motor function. In certain embodiments, cognition is measured by novel object recognition and nestlet building activity. In certain embodiments, motor function is measured by walking initiation analysis, rotarod, grip strength, pole climb, open field performance, balance beam, hindpaw footprint testing in the animal. In certain embodiments, antisense compounds, for example, antisense oligonucleotides, are tested in animals to assess their ability to reduce hyperphosphorylated tau and neurofibrillary tangles. In certain embodiments, antisense compounds, for example, antisense oligonucleotides, are tested to assess their ability to prevent, and/or reduce severity of, seizures in a pentylenetetrazol (PTZ) induced seizure model.

Testing may be performed in normal animals, or in experimental disease models. For administration to animals, antisense oligonucleotides are formulated in a pharmaceutically acceptable diluent, such as phosphate-buffered saline. Administration includes parenteral routes of administration, such as intraperitoneal, intravenous, and subcutaneous. Calculation of antisense oligonucleotide dosage and dosing frequency is within the abilities of those skilled in the art, and depends upon factors such as route of administration and animal body weight. Following a period of treatment with antisense oligonucleotides, RNA is isolated from CNS tissue or CSF and changes in Tau nucleic acid expression are measured.

Certain Indications

In certain embodiments, provided herein are methods, compounds, and compositions of treating an individual comprising administering one or more pharmaceutical compositions described herein. In certain embodiments, the individual has a neurodegenerative disease. In certain embodiments, the individual is at risk for developing a neurodegenerative disease, including, but not limited to, a Tauopathy, Alzheimer's Disease, Fronto-temporal Dementia (FTD), FTDP-17, Progressive Supranuclear Palsy (PSP), Chronic Traumatic Encephalopathy (CTE), Corticobasal Ganglionic Degeneration (CBD), Epilepsy, and Dravet's Syndrome. In certain embodiments, the individual has been identified as having a Tau associated disease. In certain embodiments, provided herein are methods for prophylactically reducing Tau expression in an individual. Certain embodiments include treating an individual in need thereof by administering to an individual a therapeutically effective amount of an antisense compound targeted to a Tau nucleic acid.

In one embodiment, administration of a therapeutically effective amount of an antisense compound targeted to a Tau nucleic acid is accompanied by monitoring of Tau levels in an individual, to determine an individual's response to administration of the antisense compound. An individual's response to administration of the antisense compound may be used by a physician to determine the amount and duration of therapeutic intervention.

In certain embodiments, administration of an antisense compound targeted to a Tau nucleic acid results in reduction of Tau expression by at least 15, 20, 25, 30, 35, 40, 45, 50, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100%, or a range defined by any two of these values. In certain embodiments, administration of an antisense compound targeted to a Tau nucleic acid results in improved motor function in an animal. In certain embodiments, administration of a Tau antisense compound improves motor function by at least 15, 20, 25, 30, 35, 40, 45, 50, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100%, or a range defined by any two of these values.

In certain embodiments, pharmaceutical compositions comprising an antisense compound targeted to Tau are used for the preparation of a medicament for treating a patient suffering or susceptible to a neurodegenerative disease including a Tauopathy, Alzheimer's Disease, Fronto-temporal Dementia (FTD), FTDP-17, Progressive Supranuclear Palsy (PSP), Chronic Traumatic Encephalopathy (CTE), Corticobasal Ganglionic Degeneration (CBD), Epilepsy, and Dravet's Syndrome.

Certain Hotspot Regions

1. Nucleobases 135783-135980 of SEQ ID NO: 1

In certain embodiments, antisense oligonucleotides are designed to target nucleobases 135783-135980 of SEQ ID NO: 1 (GENBANK Accession No. GENBANK Accession No. NT_010783.15 truncated from nucleotides 9240000 to 9381000). In certain embodiments, nucleobases 135783-135980 are a hotspot region. In certain embodiments, nucleobases 135783-135980 are targeted by antisense oligonucleotides. In certain embodiments, the antisense oligonucleotides are 18, 19, or 20 nucleobases in length. In certain embodiments, the antisense oligonucleotides are gapmers. In certain embodiments, the gapmers are 5-10-5 MOE gapmers, 5-9-5 MOE gapmers, 5-7-6 MOE gapmers, and 5-8-5 MOE gapmers. In certain embodiments, the nucleosides of the antisense oligonucleotides are linked by phosphorothioate internucleoside linkages. In certain embodiments, the nucleosides of the antisense oligonucleotides are linked by phosphodiester internucleoside linkages. In certain embodiments, the nucleosides of the antisense oligonucleotides are linked by phosphorothioate and phosphodiester internucleotide linkages (e.g., the antisense oligonucleotides have "mixed backbones").

In certain embodiments, nucleobases 135783-135980 are targeted by the following ISIS numbers: 424879, 424880, 548937, 613114-613120, 622096-622150, 623988-623996, 664511-664542, and 664661-664819.

In certain embodiments, nucleobases 135783-135980 are targeted by the following SEQ ID NOs: 56, 57, 248, 462-467, 1668-1698, 2025-2048, 2301-2309, 2331-2443, and 2478-2483.

In certain embodiments, antisense oligonucleotides targeting nucleobases 135783-135980 achieve at least 12%, at least 13%, at least 14%, at least 15%, at least 16%, at least 17%, at least 18%, at least 19%, 20%, at least 21%, at least 22%, at least 23%, at least 24%, at least 25%, at least 26%, at least 27%, at least 28%, at least 29%, at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, or at least 93% reduction of Tau mRNA and/or protein levels in vitro and/or in vivo.

2. Nucleobases 135853-135872 of SEQ ID NO: 1

In certain embodiments, antisense oligonucleotides are designed to target nucleobases 135853-135872 of SEQ ID NO: 1 (GENBANK Accession No. GENBANK Accession No. NT_010783.15 truncated from nucleotides 9240000 to 9381000). In certain embodiments, nucleobases 135853-135872 are a hotspot region. In certain embodiments, nucleobases 135853-135872 are targeted by antisense oligonucleotides. In certain embodiments, the antisense oligonucleotides are 18, 19, or 20 nucleobases in length. In certain embodiments, the antisense oligonucleotides are gapmers. In certain embodiments, the gapmers are 5-10-5 MOE gapmers, 5-9-5 MOE gapmers, 5-7-6 MOE gapmers, or 5-8-5 MOE gapmers. In certain embodiments, the nucleosides of the antisense oligonucleotides are linked by phosphorothioate internucleoside linkages. In certain embodiments, the nucleosides of the antisense oligonucleotides are linked by phosphodiester internucleoside linkages. In certain embodiments, the nucleosides of the antisense oligonucleotides are linked by phosphorothioate and phosphodiester internucleotide linkages (e.g., the antisense oligonucleotides have "mixed backbones").

In certain embodiments, nucleobases 135853-135872 are targeted by the following ISIS numbers: 424879, 424880, 613117, 613118, 622114-622125, 623993-623996, 664522-664542, 664676-664713, 664729-664766, and 664783-664819.

In certain embodiments, nucleobases 135853-135872 are targeted by the following SEQ ID NOs: 56, 57, 248, 464-465, 1668-1673, 2039-2048, 2306-2309, 2345-2443, and 2478-2483.

In certain embodiments, antisense oligonucleotides targeting nucleobases 135853-135872 achieve at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, or at least 87% reduction of Tau mRNA and/or protein levels in vitro and/or in vivo.

3. Nucleobases 135783-135929 of SEQ ID NO: 1

In certain embodiments, antisense oligonucleotides are designed to target nucleobases 135783-135929 of SEQ ID NO: 1 (GENBANK Accession No. GENBANK Accession No. NT_010783.15 truncated from nucleotides 9240000 to 9381000). In certain embodiments, nucleobases 135783-135929 are a hotspot region. In certain embodiments, nucleobases 135783-135929 are targeted by antisense oligonucleotides. In certain embodiments, the antisense oligonucleotides are 18, 19, or 20 nucleobases in length. In certain embodiments, the antisense oligonucleotides are gapmers. In certain embodiments, the gapmers are 5-10-5 MOE gapmers, 5-9-5 MOE gapmers, 5-7-6 MOE gapmers, or 5-8-5 MOE gapmers. In certain embodiments, the nucleosides of the antisense oligonucleotides are linked by phosphorothioate internucleoside linkages. In certain embodiments, the nucleosides of the antisense oligonucleotides are linked by phosphodiester internucleoside linkages. In certain embodiments, the nucleosides of the antisense oligonucleotides are linked by phosphorothioate and phosphodiester internucleotide linkages (e.g., the antisense oligonucleotides have "mixed backbones").

In certain embodiments, nucleobases 135783-135929 are targeted by the following ISIS numbers: 424879, 424880, 548937, 613114-613119, 622096-622138, 623988-623996, 664511-664542, and 664661-664819.

In certain embodiments, nucleobases 135783-135929 are targeted by the following SEQ ID NOs: 56, 57, 248, 462-466, 1668-1686, 2025-2048, 2301-2309, 2331-2443, and 2478-2483.

In certain embodiments, antisense oligonucleotides targeting nucleobases 135783-135929 achieve at least 12%, at least 13%, at least 14%, at least 15%, at least 16%, at least 17%, at least 18%, at least 19%, 20%, at least 21%, at least 22%, at least 23%, at least 24%, at least 25%, at least 26%, at least 27%, at least 28%, at least 29%, at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, or at least 93% reduction of Tau mRNA and/or protein levels in vitro and/or in vivo.

4. Nucleobases 135783-135914 of SEQ ID NO: 1

In certain embodiments, antisense oligonucleotides are designed to target nucleobases 135783-135914 of SEQ ID NO: 1 (GENBANK Accession No. GENBANK Accession No. NT_010783.15 truncated from nucleotides 9240000 to 9381000). In certain embodiments, nucleobases 135783-135914 are a hotspot region. In certain embodiments, nucleobases 135783-135914 are targeted by antisense oligonucleotides. In certain embodiments, the antisense oligonucleotides are 18, 19, or 20 nucleobases in length. In certain embodiments, the antisense oligonucleotides are gapmers. In certain embodiments, the gapmers are 5-10-5 MOE gapmers, 5-9-5 MOE gapmers, 5-7-6 MOE gapmers, or 5-8-5 MOE gapmers. In certain embodiments, the nucleosides of the antisense oligonucleotides are linked by phosphorothioate internucleoside linkages. In certain embodiments, the nucleosides of the antisense oligonucleotides are linked by phosphodiester internucleoside linkages. In certain embodiments, the nucleosides of the antisense oligonucleotides are linked by phosphorothioate and phosphodiester internucleotide linkages (e.g., the antisense oligonucleotides have "mixed backbones").

In certain embodiments, nucleobases 135783-135914 are targeted by the following ISIS numbers: 424879, 424880, 548937, 613114-613119, 622096-622133, 623988-623996, 664511-664542, 664661-664819.

In certain embodiments, nucleobases 135783-135914 are targeted by the following SEQ ID NOs: 56, 57, 248, 462-466, 1668-1681, 2025-2048, 2301-2309, 2331-2443, and 2478-2483.

In certain embodiments, nucleobases 135783-135914 are targeted by the following ISIS numbers: 424879, 424880, 548937, 613114-613119, 622096-622133, and 623988-623996.

In certain embodiments, nucleobases 135783-135914 are targeted by the following SEQ ID NOs: 56, 57, 248, 462-466, 1668-1681, 2025-2048, and 2301-2309.

In certain embodiments, antisense oligonucleotides targeting nucleobases 135783-135914 achieve at least 12%, at least 13%, at least 14%, at least 15%, at least 16%, at least 17%, at least 18%, at least 19%, 20%, at least 21%, at least 22%, at least 23%, at least 24%, at least 25%, at least 26%, at least 27%, at least 28%, at least 29%, at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, or at least 93% reduction of Tau mRNA and/or protein levels in vitro and/or in vivo.

EXAMPLES

Non-Limiting Disclosure and Incorporation by Reference

While certain compounds, compositions, and methods described herein have been described with specificity in accordance with certain embodiments, the following examples serve only to illustrate the compounds described herein and are not intended to limit the same. Each of the references recited in the present application is incorporated herein by reference in its entirety.

Example 1

Antisense Inhibition of Human Tau in HepG2 Cells by MOE Gapmers

Antisense oligonucleotides were designed targeting a tau nucleic acid and were tested for their effects on tau mRNA in vitro. Cultured HepG2 cells were transfected using Lipofectin reagent with 100 nM antisense oligonucleotide. After a treatment period of approximately 24 hours, RNA was isolated from the cells and tau mRNA levels were measured by quantitative real-time PCR. Human primer probe set RTS3104 (forward sequence AAGATTGGGTCCCTGGA-CAAT, designated herein as SEQ ID NO: 10; reverse sequence AGCTTGTGGGTTTCAATCTTTTTATT, designated herein as SEQ ID NO: 11; probe sequence CAC-CCACGTCCCTGGCGGA, designated herein as SEQ ID NO: 12) was used to measure mRNA levels. Tau mRNA levels were adjusted according to total RNA content, as measured by RIBOGREEN®. Results are presented as percent inhibition of tau, relative to untreated control cells.

The newly designed chimeric antisense oligonucleotides in the Tables below were designed as 5-10-5 MOE gapmers. The gapmers are 20 nucleosides in length, wherein the central gap segment comprises ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are phosphorothioate linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in Table 1 below is targeted to either the human tau genomic sequence, designated herein as SEQ ID NO: 1 (GENBANK Accession No. NT_010783.15 truncated from nucleotides 9240000 to 9381000) or to the human tau mRNA sequence, designated herein as SEQ ID NO: 2 (GENBANK Accession No. NM_001123066.3). 'n/a' indicates that the oligonucleotide does not target the gene sequence with 100% complementarity. The sequences listed in Table 2 do not target either SEQ ID NO: 1 or 2 with 100% complementarity, but instead target SEQ ID NO: 3 (GENBANK Accession No. NM_016841.4, a variant mRNA sequence which skips exons 3, 4, 6, 8, 10, and 12) or SEQ ID NO: 4 (GENBANK Accession No. NT_010783.14 truncated from nucleotides 2624000 to 2761000).

TABLE 1

Inhibition of Tau mRNA by 5-10-5 MOE gapmers targeting SEQ ID NOs: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 424863 | n/a | n/a | TTGTAGACTATTTGCACACT | 59 | 2240 | 2259 | 20 |
| 433519 | 28769 | 28788 | CACAGGCAGATGCGAACCCT | 57 | n/a | n/a | 21 |
| 433520 | 47181 | 47200 | TGGTGGAGACAAGACATTCT | 57 | n/a | n/a | 22 |
| 433521 | 71387 | 71406 | CCATCCCCTAATAGTTAGCA | 29 | n/a | n/a | 23 |
| 433522 | 72861 | 72880 | CATGAGGCTTGGGATCTGAA | 49 | n/a | n/a | 24 |
| 433474 | 73879 | 73898 | GTGATCTTCCATCACTTCGA | 61 | 345 | 364 | 25 |
| 433523 | 73980 | 73999 | GTCCACTAACCTTTCAGGCC | 63 | n/a | n/a | 26 |
| 433518 | 83423 | 83442 | AGCATCAGAGGTTTCAGAGC | 46 | 501 | 520 | 27 |
| 424852 | 83437 | 83456 | GTTGGAGTGCTCTTAGCATC | 58 | 515 | 534 | 28 |
| 433513 | 85934 | 85953 | GGCAGCCTGCTTGCCGGGAG | 68 | 573 | 592 | 29 |
| 433524 | 87927 | 87946 | GAGGATTTCCTTGGAGAGAG | 53 | n/a | n/a | 30 |
| 433525 | 89950 | 89969 | GTTCACTGACCTTGGGTCAC | 38 | n/a | n/a | 31 |

TABLE 1-continued

Inhibition of Tau mRNA
by 5-10-5 MOE gapmers targeting SEQ ID NOs: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 433526 | 91248 | 91267 | ATGATTTCTAGAGGTCATGC | 61 | n/a | n/a | 32 |
| 433514 | 95121 | 95140 | AGAGGAAATCCACAGGGAGG | 43 | 1120 | 1139 | 33 |
| 433515 | 95372 | 95391 | TTCAGAGGGCTCTGGAAGGT | 58 | 1371 | 1390 | 34 |
| 433527 | 95790 | 95809 | ACACCATGAGGGCACCCGTC | 65 | n/a | n/a | 35 |
| 433528 | 98549 | 98568 | ACCATGCGAGCTGATAAAAT | 46 | n/a | n/a | 36 |
| 433516 | 101406 | 101425 | AAGGTTTTAGCAGAGGAACG | 50 | 1514 | 1533 | 37 |
| 433517 | 101507 | 101526 | AGGAAGGTGGCTCTGGGCAC | 73 | 1615 | 1634 | 38 |
| 433476 | 103087 | 103106 | CCAGAGCTGGGTGGTGTCTT | 60 | n/a | n/a | 39 |
| 433477 | 108040 | 108059 | GGTGGAGTACGGACCACTGC | 71 | 2006 | 2025 | 40 |
| 433478 | 108054 | 108073 | AAGACGGCGACTTGGGTGGA | 65 | 2020 | 2039 | 41 |
| 424857 | 108148 | 108167 | TGGTGCTTCAGGTTCTCAGT | 54 | 2114 | 2133 | 42 |
| 433529 | 121819 | 121838 | TTATCTGCACCTTTGGTAGC | 29 | n/a | n/a | 43 |
| 424859 | 121828 | 121847 | TCTTATTAATTATCTGCACC | 50 | 2149 | 2168 | 44 |
| 424860 | 121838 | 121857 | AGATCCAGCTTCTTATTAAT | 36 | 2159 | 2178 | 45 |
| 424861 | 121846 | 121865 | CGTTGCTAAGATCCAGCTTC | 48 | 2167 | 2186 | 46 |
| 424862 | 121865 | 121884 | GAGCCACACTTGGACTGGAC | 79 | 2186 | 2205 | 47 |
| 433530 | 122497 | 122516 | GGTGGCGCAGGCTAAGCATA | 52 | n/a | n/a | 48 |
| 424864 | 125798 | 125817 | GAGCCACACTTGGAGGTCAC | 63 | 2279 | 2298 | 49 |
| 433531 | 125834 | 125853 | ACAGGGCTACCTGGTTTATG | 53 | n/a | n/a | 50 |
| 424866 | 130141 | 130160 | ATTTTACTTCCACCTGGCCA | 70 | 2329 | 2348 | 51 |
| 433479 | 130188 | 130207 | GGACCCAATCTTCGACTGGA | 70 | 2376 | 2395 | 52 |
| 424926 | 135467 | 135486 | GTGGGTTTCAATCTGCAAGA | 39 | n/a | n/a | 53 |
| 424869 | 135475 | 135494 | GTCAGCTTGTGGGTTTCAAT | 74 | 2438 | 2457 | 54 |
| 433480 | 135673 | 135692 | GATCACAAACCCTGCTTGGC | 60 | 2636 | 2655 | 55 |
| 424879 | 135848 | 135867 | TGATTTTGAAGTCCCGAGCC | 64 | 2811 | 2830 | 56 |
| 424880 | 135853 | 135872 | ATCACTGATTTTGAAGTCCC | 54 | 2816 | 2835 | 57 |
| 433481 | 136033 | 136052 | CAGAAGCAGCTTTCAGAGCC | 38 | 2996 | 3015 | 58 |
| 433482 | 136118 | 136137 | AAATCCTTTGTTGCTGCCAC | 37 | 3081 | 3100 | 59 |
| 424882 | 136425 | 136444 | CCCACAGGCTGCCCTGCAGA | 57 | 3388 | 3407 | 60 |
| 433483 | 136491 | 136510 | GGAGGTCATCCACGAAGTGC | 67 | 3454 | 3473 | 61 |
| 433484 | 136577 | 136596 | GGAAGCCCCTCAACTCAGGC | 28 | 3540 | 3559 | 62 |
| 433485 | 136655 | 136674 | GGTCTGCAAAGTGGCCAAAA | 49 | 3618 | 3637 | 63 |
| 424883 | 136675 | 136694 | TGGTTAGCCCTAAAGTCCCA | 54 | 3638 | 3657 | 64 |
| 433486 | 136686 | 136705 | ACAAAGAGAACTGGTTAGCC | 39 | 3649 | 3668 | 65 |
| 424884 | 136703 | 136722 | AAGAGGCACAAGTCCTTACA | 40 | 3666 | 3685 | 66 |
| 433487 | 136748 | 136767 | CAGAGATGCCAGTGGCCCAG | 70 | 3711 | 3730 | 67 |

TABLE 1-continued

Inhibition of Tau mRNA
by 5-10-5 MOE gapmers targeting SEQ ID NOs: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 433488 | 137083 | 137102 | GGAACCGAATCAGATCATGA | 54 | 4046 | 4065 | 68 |
| 433489 | 137387 | 137406 | TGGAGGGCTGATACTATGCA | 45 | 4350 | 4369 | 69 |
| 433490 | 137430 | 137449 | AAAAGAACCATTTCCAAGGG | 41 | 4393 | 4412 | 70 |
| 433491 | 137540 | 137559 | ATCCAACTACAACTCAACAG | 17 | 4503 | 4522 | 71 |
| 424894 | 137579 | 137598 | ATCATAGTCACTCTGGTGAA | 56 | 4542 | 4561 | 72 |
| 433492 | 137694 | 137713 | GCCACACGAGTCCCAGTGTG | 45 | 4657 | 4676 | 73 |
| 433493 | 137731 | 137750 | AAAACTTGGGAGGCCCCAGC | 50 | 4694 | 4713 | 74 |
| 433494 | 138173 | 138192 | GATCCAGGACAGGCAATTCA | 58 | 5136 | 5155 | 75 |
| 433495 | 138205 | 138224 | TCCTCAGGCAGGCAGCTTGG | 49 | 5168 | 5187 | 76 |
| 433496 | 138303 | 138322 | TTCTCATGGCAGCAGATGGA | 51 | 5266 | 5285 | 77 |
| 433497 | 138338 | 138357 | TTAGGCAGCAATGTTTTGCA | 18 | 5301 | 5320 | 78 |
| 433498 | 138503 | 138522 | AGAGTTCTGGGCCCAGAGAC | 73 | 5466 | 5485 | 79 |
| 433499 | 138675 | 138694 | AGGAAGAGGAACCGAGGTGC | 59 | 5638 | 5657 | 80 |
| 433500 | 138774 | 138793 | TCTTAGGCTGGCCCCAAGAG | 36 | 5737 | 5756 | 81 |
| 433501 | 138812 | 138831 | TCAATTTATCTGCCAGCACT | 28 | 5775 | 5794 | 82 |
| 433502 | 138845 | 138864 | TCCTCATTTAAGATCACAAG | 36 | 5808 | 5827 | 83 |
| 433503 | 138983 | 139002 | ATGGAACTATTGATAAAGTG | 47 | 5946 | 5965 | 84 |
| 433504 | 139003 | 139022 | CACCACTGAAGTCAATTTAA | 23 | 5966 | 5985 | 85 |
| 433505 | 139112 | 139131 | AGTTTAAGTGCTGCACCCCA | 52 | 6075 | 6094 | 86 |
| 433506 | 139137 | 139156 | GAAATCATGAAAAGGGTTAC | 25 | 6100 | 6119 | 87 |
| 433507 | 139154 | 139173 | CTCTAGCAAATGTGGTTGAA | 42 | 6117 | 6136 | 88 |
| 433508 | 139229 | 139248 | AGCCAGCTGCCTGGGAAAGC | 70 | 6192 | 6211 | 89 |
| 433509 | 139359 | 139378 | TAGAGGGAAGGATGCCAAGG | 56 | 6322 | 6341 | 90 |
| 433510 | 139406 | 139425 | GTGTGTCTGGAGCCAGTGTG | 49 | 6369 | 6388 | 91 |
| 424910 | 139675 | 139694 | GAAATCATGGGACTTGCAAG | 52 | 6638 | 6657 | 92 |
| 433512 | 139729 | 139748 | AAAGCTAAGCTAAGATGATT | 31 | 6692 | 6711 | 93 |
| 424913 | 139797 | 139816 | TTACAGCAACAGTCAGTGTA | 42 | 6760 | 6779 | 94 |

TABLE 2

Inhibition of Tau mRNA by 5-10-5 MOE gapmers targeting SEQ ID NOs: 3 and 4

| ISIS NO | Target SEQ ID NO | Target Start Site | Sequence | % inhibition | SEQ ID NO |
|---|---|---|---|---|---|
| 424917 | 3 | 968 | TTGTAGACTATTTGCACCTT | 51 | 95 |
| 433475 | 3 | 443 | TCTTCAGCTTTCAGGCCAGC | 68 | 96 |
| 433511 | 4 | 135519 | AGAAGTTTTATGAAGCCGCA | 13 | 97 |

Example 2

Dose-Dependent Antisense Inhibition of Human Tau in HepG2 Cells by 5-10-5 MOE Gapmers Gapmers from studies described above exhibiting significant in vitro inhibition of Tau mRNA were selected and tested at various doses in HepG2 cells. Cells were plated at a density of 10,000 cells per well and transfected using Lipofectin reagent with 12.5 nM, 25.0 nM, 50.0 nM, 100.0 nM, or 200.0 nM concentrations of antisense oligonucleotide, as specified in the Table below. After a treatment period of approximately 16 hours, RNA was isolated from the cells and Tau mRNA levels were measured by quantitative real-time PCR. Human primer probe set RTS3104 was used to measure mRNA levels. Tau mRNA levels were adjusted according to total RNA content, as measured by RIBOGREEN®. Results are presented as percent inhibition of tau, relative to untreated control cells. Tau mRNA levels were significantly reduced in a dose-dependent manner in antisense oligonucleotide treated cells.

TABLE 3

| ISIS No | 12.5 nM | 25.0 nM | 50.0 nM | 100.0 nM | 200.0 nM |
|---|---|---|---|---|---|
| 424862 | 17 | 24 | 41 | 64 | 84 |
| 424866 | 14 | 25 | 47 | 63 | 84 |
| 433498 | 27 | 42 | 61 | 79 | 82 |
| 433508 | 25 | 31 | 53 | 66 | 83 |
| 433517 | 25 | 34 | 57 | 72 | 78 |
| 433487 | 18 | 30 | 38 | 60 | 76 |
| 433477 | 23 | 31 | 51 | 71 | 80 |
| 433475 | 18 | 33 | 57 | 71 | 85 |
| 433513 | 24 | 30 | 50 | 71 | 77 |
| 433483 | 23 | 28 | 41 | 58 | 74 |
| 433527 | 19 | 32 | 46 | 60 | 77 |

Example 3

Antisense Inhibition of Human Tau in SH-SY5Y Cells by 5-10-5 MOE Gapmers

Additional antisense oligonucleotides were designed targeting a Tau nucleic acid and were tested for their effects on Tau mRNA in vitro. The antisense oligonucleotides were tested in a series of experiments that had similar culture conditions. The results for each experiment are presented in separate tables shown below. Cultured SH-SY5Y cells were transfected using electroporation with 7,000 nM antisense oligonucleotide. After a treatment period of approximately 24 hours, RNA was isolated from the cells and Tau mRNA levels were measured by quantitative real-time PCR. Human primer probe set RTS3104 was used to measure mRNA levels. Tau mRNA levels were adjusted according to total RNA content, as measured by RIBOGREEN®. Results are presented as percent inhibition of Tau, relative to untreated control cells.

The newly designed chimeric antisense oligonucleotides in the Tables below were designed as 5-10-5 MOE gapmers. The gapmers are 20 nucleosides in length, wherein the central gap segment comprises ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are phosphorothioate linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either the human Tau genomic sequence, designated herein as SEQ ID NO: 1 (GENBANK Accession No. NT_010783.15 truncated from nucleotides 9240000 to 9381000) or to the human Tau mRNA sequence, designated herein as SEQ ID NO: 2 (GENBANK Accession No. NM_001123066.3). 'n/a' indicates that the antisense oligonucleotide does not target that particular gene sequence with 100% complementarity.

TABLE 4

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 548786 | 73867 | 73886 | CACTTCGAACTCCTGGCGGG | 73 | 333 | 352 | 98 |
| 548787 | 73869 | 73888 | ATCACTTCGAACTCCTGGCG | 64 | 335 | 354 | 99 |
| 548788 | 73871 | 73890 | CCATCACTTCGAACTCCTGG | 78 | 337 | 356 | 100 |
| 548789 | 73873 | 73892 | TTCCATCACTTCGAACTCCT | 49 | 339 | 358 | 101 |
| 548790 | 73875 | 73894 | TCTTCCATCACTTCGAACTC | 33 | 341 | 360 | 102 |
| 548791 | 73877 | 73896 | GATCTTCCATCACTTCGAAC | 54 | 343 | 362 | 103 |

TABLE 4-continued

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 433474 | 73879 | 73898 | GTGATCTTCCATCACTTCGA | 86 | 345 | 364 | 25 |
| 548792 | 73906 | 73925 | CCTGTCCCCCAACCCGTACG | 38 | 372 | 391 | 104 |
| 548793 | 73908 | 73927 | TTCCTGTCCCCCAACCCGTA | 58 | 374 | 393 | 105 |
| 548794 | 73910 | 73929 | CTTTCCTGTCCCCCAACCCG | 55 | 376 | 395 | 106 |
| 548795 | 73912 | 73931 | ATCTTTCCTGTCCCCCAACC | 14 | 378 | 397 | 107 |
| 548796 | 73914 | 73933 | TGATCTTTCCTGTCCCCCAA | 59 | 380 | 399 | 108 |
| 548797 | 73916 | 73935 | CCTGATCTTTCCTGTCCCCC | 67 | 382 | 401 | 109 |
| 548798 | 73918 | 73937 | CCCCTGATCTTTCCTGTCCC | 67 | 384 | 403 | 110 |
| 548799 | 73920 | 73939 | CCCCCCTGATCTTTCCTGTC | 33 | 386 | 405 | 111 |
| 548800 | 73922 | 73941 | AGCCCCCCTGATCTTTCCTG | 45 | 388 | 407 | 112 |
| 548801 | 73924 | 73943 | GTAGCCCCCCTGATCTTTCC | 62 | 390 | 409 | 113 |
| 548802 | 73926 | 73945 | GTGTAGCCCCCCTGATCTTT | 42 | 392 | 411 | 114 |
| 548803 | 73928 | 73947 | TGGTGTAGCCCCCCTGATCT | 58 | 394 | 413 | 115 |
| 548804 | 73930 | 73949 | CATGGTGTAGCCCCCCTGAT | 62 | 396 | 415 | 116 |
| 548805 | 73932 | 73951 | TGCATGGTGTAGCCCCCCTG | 82 | 398 | 417 | 117 |
| 548806 | 73934 | 73953 | GGTGCATGGTGTAGCCCCCC | 79 | 400 | 419 | 118 |
| 548807 | 73936 | 73955 | TTGGTGCATGGTGTAGCCCC | 58 | 402 | 421 | 119 |
| 548808 | 73938 | 73957 | TCTTGGTGCATGGTGTAGCC | 60 | 404 | 423 | 120 |
| 548809 | 73940 | 73959 | GGTCTTGGTGCATGGTGTAG | 67 | 406 | 425 | 121 |
| 548810 | 73945 | 73964 | CTCTTGGTCTTGGTGCATGG | 61 | 411 | 430 | 122 |
| 548811 | 73958 | 73977 | CGTCCGTGTCACCCTCTTGG | 73 | 424 | 443 | 123 |
| 548812 | 98559 | 98578 | GCTTTTACTGACCATGCGAG | 68 | 1449 | 1468 | 124 |
| 548813 | 98561 | 98580 | TTGCTTTTACTGACCATGCG | 64 | 1451 | 1470 | 125 |
| 548814 | 98563 | 98582 | CTTTGCTTTTACTGACCATG | 40 | 1453 | 1472 | 126 |
| 548815 | 98565 | 98584 | GTCTTTGCTTTTACTGACCA | 60 | 1455 | 1474 | 127 |
| 548816 | 98567 | 98586 | CCGTCTTTGCTTTTACTGAC | 50 | 1457 | 1476 | 128 |
| 548817 | 98569 | 98588 | TCCCGTCTTTGCTTTTACTG | 46 | 1459 | 1478 | 129 |
| 548818 | 98571 | 98590 | AGTCCCGTCTTTGCTTTTAC | 41 | 1461 | 1480 | 130 |
| 548819 | 98573 | 98592 | CCAGTCCCGTCTTTGCTTTT | 37 | 1463 | 1482 | 131 |
| 548820 | 98577 | 98596 | GCTTCCAGTCCCGTCTTTGC | 43 | 1467 | 1486 | 132 |
| 548821 | 98579 | 98598 | TCGCTTCCAGTCCCGTCTTT | 35 | 1469 | 1488 | 133 |
| 548822 | 98581 | 98600 | CATCGCTTCCAGTCCCGTCT | 73 | 1471 | 1490 | 134 |
| 548823 | 98583 | 98602 | GTCATCGCTTCCAGTCCCGT | 63 | 1473 | 1492 | 135 |
| 548824 | 98585 | 98604 | TTGTCATCGCTTCCAGTCCC | 50 | 1475 | 1494 | 136 |
| 548825 | 98587 | 98606 | TTTTGTCATCGCTTCCAGTC | 46 | 1477 | 1496 | 137 |
| 548826 | 103023 | 103042 | GGCCCTTCTGGCCTGGAGGG | 64 | 1747 | 1766 | 138 |
| 548827 | 103025 | 103044 | CTGGCCCTTCTGGCCTGGAG | 29 | 1749 | 1768 | 139 |

TABLE 4-continued

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 548828 | 103027 | 103046 | GCCTGGCCCTTCTGGCCTGG | 40 | 1751 | 1770 | 140 |
| 548829 | 103029 | 103048 | TGGCCTGGCCCTTCTGGCCT | 12 | 1753 | 1772 | 141 |
| 548830 | 103031 | 103050 | GTTGGCCTGGCCCTTCTGGC | 53 | 1755 | 1774 | 142 |
| 548831 | 103052 | 103071 | TTTTGCTGGAATCCTGGTGG | 20 | 1776 | 1795 | 143 |
| 548832 | 103054 | 103073 | GTTTTTGCTGGAATCCTGGT | 29 | 1778 | 1797 | 144 |
| 548833 | 103056 | 103075 | GGGTTTTTGCTGGAATCCTG | 51 | 1780 | 1799 | 145 |
| 548834 | 103075 | 103094 | GGTGTCTTTGGAGCGGGCGG | 44 | 1799 | 1818 | 146 |
| 548835 | 103077 | 103096 | GTGGTGTCTTTGGAGCGGGC | 30 | 1801 | 1820 | 147 |
| 548836 | 103079 | 103098 | GGGTGGTGTCTTTGGAGCGG | 38 | 1803 | 1822 | 148 |
| 548837 | 103081 | 103100 | CTGGGTGGTGTCTTTGGAGC | 29 | 1805 | 1824 | 149 |
| 548838 | 103083 | 103102 | AGCTGGGTGGTGTCTTTGGA | 37 | 1807 | 1826 | 150 |
| 548839 | 103085 | 103104 | AGAGCTGGGTGGTGTCTTTG | 0 | 1809 | 1828 | 151 |
| 548840 | 107921 | 107940 | ATCCCCTGATTTTGGAGGTT | 27 | 1887 | 1906 | 152 |
| 548841 | 107923 | 107942 | CGATCCCCTGATTTTGGAGG | 65 | 1889 | 1908 | 153 |
| 548842 | 107925 | 107944 | TGCGATCCCCTGATTTTGGA | 53 | 1891 | 1910 | 154 |
| 548843 | 107927 | 107946 | GCTGCGATCCCCTGATTTTG | 23 | 1893 | 1912 | 155 |
| 548844 | 107929 | 107948 | CCGCTGCGATCCCCTGATTT | 32 | 1895 | 1914 | 156 |
| 548845 | 107931 | 107950 | AGCCGCTGCGATCCCCTGAT | 51 | 1897 | 1916 | 157 |
| 548846 | 107933 | 107952 | GTAGCCGCTGCGATCCCCTG | 14 | 1899 | 1918 | 158 |
| 548847 | 107968 | 107987 | CGGCTGCCGGGAGTGCCTGG | 33 | 1934 | 1953 | 159 |
| 548848 | 107970 | 107989 | AGCGGCTGCCGGGAGTGCCT | 52 | 1936 | 1955 | 160 |
| 548849 | 107972 | 107991 | GGAGCGGCTGCCGGGAGTGC | 44 | 1938 | 1957 | 161 |
| 548850 | 108047 | 108066 | CGACTTGGGTGGAGTACGGA | 10 | 2013 | 2032 | 162 |
| 548851 | 108049 | 108068 | GGCGACTTGGGTGGAGTACG | 29 | 2015 | 2034 | 163 |
| 548852 | 108051 | 108070 | ACGGCGACTTGGGTGGAGTA | 39 | 2017 | 2036 | 164 |
| 548853 | 108053 | 108072 | AGACGGCGACTTGGGTGGAG | 6 | 2019 | 2038 | 165 |
| 548854 | 108055 | 108074 | GAAGACGGCGACTTGGGTGG | 0 | 2021 | 2040 | 166 |
| 548855 | 108057 | 108076 | CGGAAGACGGCGACTTGGGT | 40 | 2023 | 2042 | 167 |
| 548856 | 108059 | 108078 | GGCGGAAGACGGCGACTTGG | 38 | 2025 | 2044 | 168 |
| 548857 | 108061 | 108080 | TTGGCGGAAGACGGCGACTT | 41 | 2027 | 2046 | 169 |
| 548858 | 108063 | 108082 | TCTTGGCGGAAGACGGCGAC | 35 | 2029 | 2048 | 170 |
| 548859 | 108065 | 108084 | GCTCTTGGCGGAAGACGGCG | 54 | 2031 | 2050 | 171 |
| 548860 | 108067 | 108086 | CGGCTCTTGGCGGAAGACGG | 58 | 2033 | 2052 | 172 |
| 548861 | 108069 | 108088 | GGCGGCTCTTGGCGGAAGAC | 55 | 2035 | 2054 | 173 |
| 433498 | 138503 | 138522 | AGAGTTCTGGGCCCAGAGAC | 53 | 5466 | 5485 | 79 |

TABLE 5

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 548885 | n/a | n/a | GGGAGATTCTTTCAGGCCAG | 0 | 444 | 463 | 174 |
| 548893 | n/a | n/a | GAGCTTTGAGTTGAGGGACC | 0 | 1432 | 1451 | 175 |
| 548894 | n/a | n/a | GACCATGCGAGCTTTGAGTT | 13 | 1440 | 1459 | 176 |
| 548895 | n/a | n/a | TACTGACCATGCGAGCTTTG | 33 | 1444 | 1463 | 177 |
| 548881 | 6183 | 6202 | ATAGTCGACAGAGGCGAGGA | 43 | 283 | 302 | 178 |
| 548882 | 73840 | 73859 | CATCCTGGTTCAAAGTTCAC | 30 | 306 | 325 | 179 |
| 548883 | 73846 | 73865 | CTCAGCCATCCTGGTTCAAA | 39 | 312 | 331 | 180 |
| 548884 | 73847 | 73866 | GCTCAGCCATCCTGGTTCAA | 53 | 313 | 332 | 181 |
| 548886 | 83401 | 83420 | GGTTCCTCAGATCCGTCCTC | 53 | 479 | 498 | 182 |
| 548887 | 83438 | 83457 | TGTTGGAGTGCTCTTAGCAT | 33 | 516 | 535 | 183 |
| 548888 | 85939 | 85958 | TGCGCGGCAGCCTGCTTGCC | 32 | 578 | 597 | 184 |
| 548889 | 94699 | 94718 | ACCACCTTACCACTTTCAGG | 35 | 698 | 717 | 185 |
| 548890 | 94775 | 94794 | GGGAGCCCCAGGCATGCCGG | 45 | 774 | 793 | 186 |
| 548891 | 95125 | 95144 | TTGGAGAGGAAATCCACAGG | 13 | 1124 | 1143 | 187 |
| 548892 | 95131 | 95150 | GAAACTTTGGAGAGGAAATC | 0 | 1130 | 1149 | 188 |
| 548896 | 98557 | 98576 | TTTTACTGACCATGCGAGCT | 40 | 1447 | 1466 | 189 |
| 548897 | 101425 | 101444 | AAGGCAAGGCCTATTTTTCA | 34 | 1533 | 1552 | 190 |
| 548898 | 101469 | 101488 | TGGATCAGAGGGTCTGAGCT | 40 | 1577 | 1596 | 191 |
| 548899 | 101501 | 101520 | GTGGCTCTGGGCACACAGCA | 63 | 1609 | 1628 | 192 |
| 548900 | 108037 | 108056 | GGAGTACGGACCACTGCCAC | 37 | 2003 | 2022 | 193 |
| 433477 | 108040 | 108059 | GGTGGAGTACGGACCACTGC | 21 | 2006 | 2025 | 40 |
| 548862 | 108071 | 108090 | CAGGCGGCTCTTGGCGGAAG | 24 | 2037 | 2056 | 194 |
| 548863 | 108073 | 108092 | TGCAGGCGGCTCTTGGCGGA | 34 | 2039 | 2058 | 195 |
| 548864 | 108075 | 108094 | TCTGCAGGCGGCTCTTGGCG | 40 | 2041 | 2060 | 196 |
| 548865 | 108129 | 108148 | TGGAGCCGATCTTGGACTTG | 23 | 2095 | 2114 | 197 |
| 548866 | 108131 | 108150 | AGTGGAGCCGATCTTGGACT | 4 | 2097 | 2116 | 198 |
| 548901 | 108134 | 108153 | CTCAGTGGAGCCGATCTTGG | 28 | 2100 | 2119 | 199 |
| 548902 | 108136 | 108155 | TTCTCAGTGGAGCCGATCTT | 9 | 2102 | 2121 | 200 |
| 548903 | 108155 | 108174 | TCCCGGCTGGTGCTTCAGGT | 33 | 2121 | 2140 | 201 |
| 548904 | 121675 | 121694 | TTTCGGACTTGGCAGAGGCA | 50 | n/a | n/a | 202 |
| 548905 | 121728 | 121747 | GAGTGACATGCGCCACCCTG | 65 | n/a | n/a | 203 |
| 548906 | 121736 | 121755 | CTTTCGATGAGTGACATGCG | 19 | n/a | n/a | 204 |
| 548907 | 121794 | 121813 | AAAAGGATGAGTGACACGCC | 58 | n/a | n/a | 205 |
| 548908 | 121916 | 121935 | GTGAAGGTACTCACACTGCC | 34 | n/a | n/a | 206 |
| 548909 | 121917 | 121936 | TGTGAAGGTACTCACACTGC | 21 | n/a | n/a | 207 |
| 548910 | 121992 | 122011 | CTATGCAGTGTCTCGCAAGT | 39 | n/a | n/a | 208 |
| 548911 | 122001 | 122020 | GGATTTATTCTATGCAGTGT | 38 | n/a | n/a | 209 |

TABLE 5-continued

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 548912 | 122002 | 122021 | AGGATTTATTCTATGCAGTG | 37 | n/a | n/a | 210 |
| 548913 | 122015 | 122034 | TGAGAGCCCAAGAAGGATTT | 15 | n/a | n/a | 211 |
| 548914 | 122022 | 122041 | CAGATCCTGAGAGCCCAAGA | 33 | n/a | n/a | 212 |
| 548915 | 122025 | 122044 | AGCCAGATCCTGAGAGCCCA | 55 | n/a | n/a | 213 |
| 548916 | 122137 | 122156 | GGACCCAGAAATGCTGGGAC | 18 | n/a | n/a | 214 |
| 548917 | 125555 | 125574 | AAATGTGTTGTCGAAATTCT | 0 | n/a | n/a | 215 |
| 548918 | 125568 | 125587 | AGTCAGGGTGGAAAAATGTG | 0 | n/a | n/a | 216 |
| 548919 | 125578 | 125597 | AGCACATCCTAGTCAGGGTG | 39 | n/a | n/a | 217 |
| 548920 | 125587 | 125606 | GCCATGAGGAGCACATCCTA | 45 | n/a | n/a | 218 |
| 548921 | 125600 | 125619 | GTGGTTCCCAGCTGCCATGA | 38 | n/a | n/a | 219 |
| 548922 | 125603 | 125622 | ACAGTGGTTCCCAGCTGCCA | 38 | n/a | n/a | 220 |
| 548923 | 125619 | 125638 | CCCAGGCCCTTATTGGACAG | 19 | n/a | n/a | 221 |
| 548867 | 125778 | 125797 | CTTGCTCAGGTCAACTGGTT | 45 | 2259 | 2278 | 222 |
| 548925 | 125812 | 125831 | GGATGTTGCCTAATGAGCCA | 35 | 2293 | 2312 | 223 |
| 548926 | 130194 | 130213 | GTCCAGGGACCCAATCTTCG | 87 | 2382 | 2401 | 224 |
| 548927 | 130196 | 130215 | TTGTCCAGGGACCCAATCTT | 48 | 2384 | 2403 | 225 |
| 548928 | 135478 | 135497 | AAGGTCAGCTTGTGGGTTTC | 52 | 2441 | 2460 | 226 |
| 548868 | 135518 | 135537 | CTCCGCCCCGTGGTCTGTCT | 37 | 2481 | 2500 | 227 |
| 548869 | 135520 | 135539 | ATCTCCGCCCCGTGGTCTGT | 25 | 2483 | 2502 | 228 |
| 548870 | 135522 | 135541 | CGATCTCCGCCCCGTGGTCT | 48 | 2485 | 2504 | 229 |
| 548871 | 135524 | 135543 | CACGATCTCCGCCCCGTGGT | 38 | 2487 | 2506 | 230 |
| 548872 | 135526 | 135545 | TACACGATCTCCGCCCCGTG | 33 | 2489 | 2508 | 231 |
| 548873 | 135528 | 135547 | TGTACACGATCTCCGCCCCG | 22 | 2491 | 2510 | 232 |
| 548874 | 135530 | 135549 | CTTGTACACGATCTCCGCCC | 38 | 2493 | 2512 | 233 |
| 548875 | 135532 | 135551 | GACTTGTACACGATCTCCGC | 13 | 2495 | 2514 | 234 |
| 548876 | 135534 | 135553 | GCGACTTGTACACGATCTCC | 40 | 2497 | 2516 | 235 |
| 548877 | 135536 | 135555 | TGGCGACTTGTACACGATCT | 33 | 2499 | 2518 | 236 |
| 548878 | 135538 | 135557 | ACTGGCGACTTGTACACGAT | 25 | 2501 | 2520 | 237 |
| 548879 | 135540 | 135559 | CCACTGGCGACTTGTACACG | 19 | 2503 | 2522 | 238 |
| 548929 | 135546 | 135565 | CAGACACCACTGGCGACTTG | 33 | 2509 | 2528 | 239 |
| 548930 | 135593 | 135612 | GCTGCCGGTGGAGGAGACAT | 29 | 2556 | 2575 | 240 |
| 548931 | 135594 | 135613 | TGCTGCCGGTGGAGGAGACA | 19 | 2557 | 2576 | 241 |
| 548932 | 135600 | 135619 | TGTCGATGCTGCCGGTGGAG | 20 | 2563 | 2582 | 242 |
| 548933 | 135601 | 135620 | ATGTCGATGCTGCCGGTGGA | 20 | 2564 | 2583 | 243 |
| 548934 | 135610 | 135629 | GAGTCTACCATGTCGATGCT | 23 | 2573 | 2592 | 244 |
| 548880 | 135654 | 135673 | CCAGGGAGGCAGACACCTCG | 28 | 2617 | 2636 | 245 |
| 548935 | 135662 | 135681 | CTGCTTGGCCAGGGAGGCAG | 14 | 2625 | 2644 | 246 |

TABLE 5-continued

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 548936 | 135674 | 135693 | TGATCACAAACCCTGCTTGG | 25 | 2637 | 2656 | 247 |
| 548937 | 135786 | 135805 | CCGAACTGCGAGGAGCAGCT | 66 | 2749 | 2768 | 248 |
| 433498 | 138503 | 138522 | AGAGTTCTGGGCCCAGAGAC | 34 | 5466 | 5485 | 79 |

Example 4

Dose-Dependent Antisense Inhibition of Human Tau in SH-SY5Y Cells by 5-10-5 MOE Gapmers Gapmers from studies described above exhibiting significant in vitro inhibition of Tau mRNA were selected and tested at various doses in SH-SY-5Y cells. Cells were plated at a density of 20,000 cells per well and transfected using electroporation with 1.25 µM, 2.50 µM, 5.00 µM, 10.00 µM, and 20.00 µM concentrations of antisense oligonucleotide, as specified in the Table below. After a treatment period of approximately 16 hours, RNA was isolated from the cells and Tau mRNA levels were measured by quantitative real-time PCR. Human primer probe set RTS3104 was used to measure mRNA levels. Tau mRNA levels were adjusted according to total RNA content, as measured by RIBOGREEN®. Results are presented as percent inhibition of Tau, relative to untreated control cells. Tau mRNA levels were significantly reduced in a dose-dependent manner in antisense oligonucleotide treated cells.

TABLE 6

| ISIS No | 1.25 µM | 2.50 µM | 5.00 µM | 10.00 µM | 20.00 µM |
|---|---|---|---|---|---|
| 433474 | 29 | 54 | 74 | 83 | 88 |
| 433477 | 0 | 0 | 11 | 33 | 59 |
| 433498 | 0 | 10 | 30 | 53 | 71 |
| 548786 | 9 | 29 | 51 | 66 | 82 |
| 548787 | 19 | 27 | 61 | 85 | 87 |
| 548788 | 31 | 31 | 54 | 72 | 94 |
| 548805 | 19 | 48 | 62 | 81 | 96 |
| 548806 | 25 | 50 | 75 | 80 | 95 |
| 548811 | 21 | 42 | 60 | 74 | 94 |
| 548812 | 47 | 39 | 64 | 77 | 91 |
| 548822 | 0 | 32 | 52 | 62 | 91 |
| 548899 | 19 | 50 | 69 | 87 | 93 |
| 548905 | 11 | 32 | 57 | 80 | 95 |
| 548907 | 14 | 28 | 44 | 80 | 91 |
| 548937 | 24 | 43 | 66 | 82 | 91 |

Example 5

Antisense Inhibition of Human Tau in SH-SY5Y Cells by 5-10-5 MOE Gapmers

Additional antisense oligonucleotides were designed targeting a Tau nucleic acid and were tested for their effects on Tau mRNA in vitro. Cultured SH-SY5Y cells were plated at a density of 20,000 cells per well and were transfected using electroporation with 6,000 nM antisense oligonucleotide. After a treatment period of approximately 24 hours, RNA was isolated from the cells and Tau mRNA levels were measured by quantitative real-time PCR. Human primer probe set RTS3104 was used to measure mRNA levels. Tau mRNA levels were adjusted according to total RNA content, as measured by RIBOGREEN®. Results are presented as percent inhibition of tau, relative to untreated control cells.

The newly designed chimeric antisense oligonucleotides in the Tables below were designed as 5-10-5 MOE gapmers. The gapmers are 20 nucleosides in length, wherein the central gap segment comprises of ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are phosphorothioate linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to the human tau genomic sequence, designated herein as SEQ ID NO: 1 (GENBANK Accession No. NT_010783.15 truncated from nucleotides 9240000 to 9381000).

TABLE 7

| ISIS NO | SEQ ID NO: 1 Start Site | SEQ ID NO: 1 Stop Site | Sequence | % inhibition | SEQ ID NO |
|---|---|---|---|---|---|
| 433474 | 73879 | 73898 | GTGATCTTCCATCACTTCGA | 63 | 25 |
| 559166 | 26760 26944 | 26779 26963 | TGCTTACACACCACACAC | 0 | 249 |
| 559167 | 26761 26945 | 26780 26964 | ATGCTTACACACCACACACA | 4 | 250 |

TABLE 7-continued

| ISIS NO | SEQ ID NO: 1 Start Site | SEQ ID NO: 1 Stop Site | Sequence | % inhibition | SEQ ID NO |
|---|---|---|---|---|---|
| 559168 | 26762 26946 | 26781 26965 | CATGCTTACACACCACACAC | 0 | 251 |
| 559169 | 81022 81125 | 81041 81144 | TACAGATATATGATTGGATG | 0 | 252 |
| 559170 | 81023 81126 | 81042 81145 | GTACAGATATATGATTGGAT | 0 | 253 |
| 559171 | 81024 81127 | 81043 81146 | TGTACAGATATATGATTGGA | 0 | 254 |
| 559172 | 81025 81128 | 81044 81147 | ATGTACAGATATATGATTGG | 0 | 255 |
| 559173 | 81026 81129 | 81045 81148 | TATGTACAGATATATGATTG | 0 | 256 |
| 559174 | 81027 81130 | 81046 81149 | TTATGTACAGATATATGATT | 0 | 257 |
| 559175 | 81028 81131 | 81047 81150 | ATTATGTACAGATATATGAT | 0 | 258 |
| 559176 | 81029 81132 | 81048 81151 | GATTATGTACAGATATATGA | 0 | 259 |
| 559177 | 81030 81133 | 81049 81152 | GGATTATGTACAGATATATG | 0 | 260 |
| 559178 | 81031 81134 | 81050 81153 | TGGATTATGTACAGATATAT | 0 | 261 |
| 559179 | 81032 81135 | 81051 81154 | ATGGATTATGTACAGATATA | 0 | 262 |
| 559180 | 81033 81136 | 81052 81155 | AATGGATTATGTACAGATAT | 0 | 263 |
| 559181 | 81034 81137 | 81053 81156 | GAATGGATTATGTACAGATA | 0 | 264 |
| 559182 | 81035 81138 | 81054 81157 | AGAATGGATTATGTACAGAT | 0 | 265 |
| 559183 | 81036 81139 | 81055 81158 | AAGAATGGATTATGTACAGA | 0 | 266 |
| 559184 | 81037 81140 | 81056 81159 | GAAGAATGGATTATGTACAG | 0 | 267 |
| 559185 | 81038 81141 | 81057 81160 | GGAAGAATGGATTATGTACA | 0 | 268 |
| 559186 | 81039 81142 | 81058 81161 | GGGAAGAATGGATTATGTAC | 0 | 269 |
| 559187 | 81040 81143 | 81059 81162 | AGGGAAGAATGGATTATGTA | 0 | 270 |
| 559188 | 81041 81144 | 81060 81163 | GAGGGAAGAATGGATTATGT | 0 | 271 |
| 559189 | 81042 81145 | 81061 81164 | CGAGGGAAGAATGGATTATG | 0 | 272 |
| 559190 | 81043 81146 | 81062 81165 | CCGAGGGAAGAATGGATTAT | 33 | 273 |
| 559191 | 81044 81147 | 81063 81166 | ACCGAGGGAAGAATGGATTA | 12 | 274 |

TABLE 7-continued

| ISIS NO | SEQ ID NO: 1 Start Site | SEQ ID NO: 1 Stop Site | Sequence | % inhibition | SEQ ID NO |
|---|---|---|---|---|---|
| 559192 | 81045 81148 | 81064 81167 | AACCGAGGGAAGAATGGATT | 1 | 275 |
| 559193 | 81046 81149 | 81065 81168 | GAACCGAGGGAAGAATGGAT | 0 | 276 |
| 559194 | 81047 81150 | 81066 81169 | TGAACCGAGGGAAGAATGGA | 0 | 277 |
| 559195 | 81048 81151 | 81067 81170 | ATGAACCGAGGGAAGAATGG | 0 | 278 |
| 559196 | 81049 81152 | 81068 81171 | GATGAACCGAGGGAAGAATG | 0 | 279 |
| 559197 | 81050 81153 | 81069 81172 | GGATGAACCGAGGGAAGAAT | 0 | 280 |
| 559198 | 81051 81154 | 81070 81173 | TGGATGAACCGAGGGAAGAA | 0 | 281 |
| 559199 | 81052 81155 | 81071 81174 | ATGGATGAACCGAGGGAAGA | 0 | 282 |
| 559200 | 81053 81156 | 81072 81175 | GATGGATGAACCGAGGGAAG | 0 | 283 |
| 559201 | 81054 81157 | 81073 81176 | GGATGGATGAACCGAGGGAA | 1 | 284 |
| 559202 | 81055 81158 | 81074 81177 | TGGATGGATGAACCGAGGGA | 0 | 285 |
| 559203 | 81056 81159 | 81075 81178 | ATGGATGGATGAACCGAGGG | 0 | 286 |
| 559204 | 81057 81160 | 81076 81179 | GATGGATGGATGAACCGAGG | 0 | 287 |
| 559205 | 81058 81161 | 81077 81180 | GGATGGATGGATGAACCGAG | 0 | 288 |
| 559206 | 81096 81199 | 81115 81218 | AAGGATGAAGGAAGGGATGG | 0 | 289 |
| 559207 | 81097 81200 | 81116 81219 | GAAGGATGAAGGAAGGGATG | 0 | 290 |
| 559208 | 81098 81201 | 81117 81220 | GGAAGGATGAAGGAAGGGAT | 0 | 291 |
| 559209 | 81100 81203 | 81119 81222 | TAGGAAGGATGAAGGAAGGG | 0 | 292 |
| 559210 | 81101 81204 | 81120 81223 | ATAGGAAGGATGAAGGAAGG | 0 | 293 |
| 559211 | 81102 81205 | 81121 81224 | GATAGGAAGGATGAAGGAAG | 0 | 294 |
| 559212 | 81103 81206 | 81122 81225 | TGATAGGAAGGATGAAGGAA | 0 | 295 |
| 559213 | 81104 81207 | 81123 81226 | ATGATAGGAAGGATGAAGGA | 0 | 296 |
| 559214 | 81105 81208 | 81124 81227 | GATGATAGGAAGGATGAAGG | 0 | 297 |
| 559215 | 81106 81209 | 81125 81228 | GGATGATAGGAAGGATGAAG | 0 | 298 |

TABLE 7-continued

| ISIS NO | SEQ ID NO: 1 Start Site | SEQ ID NO: 1 Stop Site | Sequence | % inhibition | SEQ ID NO |
|---|---|---|---|---|---|
| 559216 | 81107 81210 | 81126 81229 | TGGATGATAGGAAGGATGAA | 0 | 299 |
| 559217 | 81108 81211 | 81127 81230 | ATGGATGATAGGAAGGATGA | 0 | 300 |
| 559218 | 81109 81212 | 81128 81231 | GATGGATGATAGGAAGGATG | 0 | 301 |
| 559219 | 81110 81213 | 81129 81232 | GGATGGATGATAGGAAGGAT | 0 | 302 |
| 559220 | 81111 81214 | 81130 81233 | TGGATGGATGATAGGAAGGA | 0 | 303 |
| 559221 | 81112 81215 | 81131 81234 | TTGGATGGATGATAGGAAGG | 0 | 304 |
| 559222 | 81113 81216 | 81132 81235 | ATTGGATGGATGATAGGAAG | 0 | 305 |
| 559223 | 81114 81217 | 81133 81236 | GATTGGATGGATGATAGGAA | 0 | 306 |
| 559224 | 81115 81218 | 81134 81237 | TGATTGGATGGATGATAGGA | 0 | 307 |
| 559225 | 81116 81219 | 81135 81238 | ATGATTGGATGGATGATAGG | 0 | 308 |
| 559226 | 81117 81220 | 81136 81239 | TATGATTGGATGGATGATAG | 0 | 309 |
| 559227 | 80890 81472 | 80909 81491 | AGATATGGGTGGATGGATGG | 0 | 310 |
| 559228 | 80891 81473 | 80910 81492 | AAGATATGGGTGGATGGATG | 0 | 311 |
| 559229 | 80892 81474 | 80911 81493 | GAAGATATGGGTGGATGGAT | 0 | 312 |
| 559230 | 98881 98918 | 98900 98937 | ACACACCTTCATTTACTGTC | 79 | 313 |
| 559231 | 98882 98919 | 98901 98938 | AACACACCTTCATTTACTGT | 56 | 314 |
| 559232 | 98883 98920 | 98902 98939 | AAACACACCTTCATTTACTG | 59 | 315 |
| 559233 | 98884 98921 | 98903 98940 | CAAACACACCTTCATTTACT | 51 | 316 |
| 559234 | 98885 98922 | 98904 98941 | TCAAACACACCTTCATTTAC | 25 | 317 |
| 559235 | 98887 98924 | 98906 98943 | TTTCAAACACACCTTCATTT | 25 | 318 |
| 559236 | 98888 98925 | 98907 98944 | TTTTCAAACACACCTTCATT | 14 | 319 |
| 559237 | 98889 98926 | 98908 98945 | GTTTTCAAACACACCTTCAT | 42 | 320 |
| 559238 | 98890 98927 | 98909 98946 | GGTTTTCAAACACACCTTCA | 79 | 321 |

TABLE 7-continued

| ISIS NO | SEQ ID NO: 1 Start Site | SEQ ID NO: 1 Stop Site | Sequence | % inhibition | SEQ ID NO |
|---|---|---|---|---|---|
| 559239 | 98891<br>98928 | 98910<br>98947 | TGGTTTTCAAACACACCTTC | 87 | 322 |
| 559240 | 111795<br>111819 | 111814<br>111838 | GAAAACAGAGAAAAGCACAA | 12 | 323 |
| 559241 | 119594<br>119905 | 119613<br>119924 | AGAAGTGATATCATATCCTA | 63 | 324 |
| 559242 | 119595<br>119906 | 119614<br>119925 | AAGAAGTGATATCATATCCT | 74 | 325 |

Example 6

Dose-Dependent Antisense Inhibition of Human Tau in SH-SY5Y Cells by 5-10-5 MOE Gapmers Gapmers from studies described above exhibiting significant in vitro inhibition of Tau mRNA were selected and tested at various doses in SH-SY-5Y cells. Cells were plated at a density of 20,000 cells per well and transfected using electroporation with 0.625 µM, 1.25 µM, 2.500 µM, 5.00 µM, 10.00 µM, and 20.00 µM concentrations of antisense oligonucleotide, as specified in the Table below. After a treatment period of approximately 16 hours, RNA was isolated from the cells and Tau mRNA levels were measured by quantitative real-time PCR. Human primer probe set RTS3104 was used to measure mRNA levels. Tau mRNA levels were adjusted according to total RNA content, as measured by RIBOGREEN®. Results are presented as percent inhibition of Tau, relative to untreated control cells. Tau mRNA levels were significantly reduced in a dose-dependent manner in antisense oligonucleotide treated cells.

TABLE 8

| ISIS No | 0.625 µM | 1.25 µM | 2.50 µM | 5.00 µM | 10.00 µM | 20.00 µM |
|---|---|---|---|---|---|---|
| 433474 | 17 | 39 | 53 | 73 | 81 | 88 |
| 559230 | 30 | 50 | 67 | 81 | 92 | 94 |
| 559231 | 0 | 16 | 26 | 44 | 63 | 83 |
| 559232 | 10 | 12 | 23 | 30 | 62 | 79 |
| 559233 | 5 | 10 | 21 | 38 | 62 | 81 |
| 559237 | 0 | 16 | 27 | 31 | 58 | 88 |
| 559238 | 25 | 18 | 72 | 77 | 86 | 86 |
| 559239 | 26 | 47 | 64 | 80 | 88 | 93 |
| 559241 | 0 | 18 | 34 | 61 | 74 | 95 |
| 559242 | 13 | 20 | 23 | 47 | 71 | 83 |

Example 7

Antisense Inhibition of Human Tau in SH-SY5Y Cells by MOE Gapmers with Phosphorothioate and Phosphodiester Internucleoside Linkages Antisense oligonucleotides were designed targeting a tau nucleic acid and were tested for their effects on tau mRNA in vitro. The antisense oligonucleotides were tested in a series of experiments that had similar culture conditions. The results for each experiment are presented in separate tables shown below. Cultured SH-SY5Y cells were transfected using electroporation with 8,000 nM antisense oligonucleotide. After a treatment period of approximately 24 hours, RNA was isolated from the cells and tau mRNA levels were measured by quantitative real-time PCR. Human primer probe set RTS3104 was used to measure mRNA levels. Tau mRNA levels were adjusted according to total RNA content, as measured by RIBOGREEN®. Results are presented as percent inhibition of tau, relative to untreated control cells.

The newly designed chimeric antisense oligonucleotides in the Tables below were designed as 5-10-5 MOE gapmers. The gapmers are 20 nucleosides in length, wherein the central gap segment comprises of ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are either phosphorothioate linkages or phosphodiester linkages. All cytosine residues throughout each gapmer are 5-methylcytosines. The 'Chemistry' column describes the internucleoside linkages of each oligonucleotide. 's' indicates phosphorothioate linkage and 'o' indicates phosphodiester linkage. "Start site" indicates the 5'-most nucleoside to which the gapmer is targeted in the human gene sequence. "Stop site" indicates the 3'-most nucleoside to which the gapmer is targeted human gene sequence.

Each gapmer listed in the Tables below is targeted to either the human Tau genomic sequence, designated herein as SEQ ID NO: 1 (GENBANK Accession No. NT_010783.15 truncated from nucleotides 9240000 to 9381000), human Tau mRNA sequences, designated herein as SEQ ID NO: 2 (GENBANK Accession No. NM_001123066.3) or SEQ ID NO: 3 (GENBANK Accession No. NM_016841.4). Several oligonucleotides, presented in Tables 10, 12, and 16, target variant mRNA sequences, designated herein as SEQ ID NO: 5 (GENBANK Accession No. DR002467.1), SEQ ID NO: 6 (GENBANK Accession No. NM_001203251.1) or SEQ ID NO: 7 (GENBANK Accession No. NM_016835.4). The oligonucleotides are presented in the various tables according to the main gene sequence that they target with 100% complementarity. 'n/a' indicates that the antisense oligonucleotide does not target that particular gene sequence with 100% complementarity.

TABLE 9

Inhibition of Tau mRNA by 5-10-5 MOE gapmers with phosphorothioate
and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 433475 | n/a | n/a | TCTTCAGCTTTCAGGCCAGC | 41 | 443 | 462 | sssssssssssssssssss | 96 |
| 613242 | n/a | n/a | CTTCAGCTTTCAGGCCAGCG | 54 | 442 | 461 | soooosssssssssssooss | 326 |
| 613243 | n/a | n/a | TCTTCAGCTTTCAGGCCAGC | 43 | 443 | 462 | soooosssssssssssooss | 96 |
| 613244 | n/a | n/a | CCATGCGAGCTTGGGTCACG | 64 | 511 | 530 | soooosssssssssssooss | 327 |
| 613245 | n/a | n/a | CAGCCCCCTTGGCTTTTTTG | 30 | 565 | 584 | soooosssssssssssooss | 328 |
| 613247 | n/a | n/a | TTGCACCTTCCCGCCTCCCG | 53 | 957 | 976 | soooosssssssssssooss | 329 |
| 613240 | 5897 | 5916 | TGCCGCTCGGCCGTCCGGCG | 9 | n/a | n/a | soooosssssssssssooss | 330 |
| 613249 | 6292 | 6311 | GCCCGGCGCACGAAGCCCCA | 80 | n/a | n/a | soooosssssssssssooss | 331 |
| 613250 | 7099 | 7118 | AGAAAGAAATCCGCCCCGAG | 45 | n/a | n/a | soooosssssssssssooss | 332 |
| 613251 | 11709 | 11728 | ATAATGGAATACTTATTGCA | 54 | n/a | n/a | soooosssssssssssooss | 333 |
| 613252 | 11819 | 11838 | GCAGGAGCATGGCACCTGGA | 79 | n/a | n/a | soooosssssssssssooss | 334 |
| 613253 | 12081 | 12100 | ACTCGCTGACATGGTGTTTG | 87 | n/a | n/a | soooosssssssssssooss | 335 |
| 613254 | 13386 | 13405 | GATGACTCCACAATGTAAAC | 75 | n/a | n/a | soooosssssssssssooss | 336 |
| 613255 | 16760 | 16779 | CCTATAGGATTATCCAGGAA | 88 | n/a | n/a | soooosssssssssssooss | 337 |
| 613256 | 16987 | 17006 | CATTTCTCATCAGCCATCGA | 81 | n/a | n/a | soooosssssssssssooss | 338 |
| 613257 | 17428 | 17447 | ACCAAAGACTTCAGATCAGC | 88 | n/a | n/a | soooosssssssssssooss | 339 |
| 613412 | 73879 | 73898 | GTGATCTTCCATCACTTCGA | 82 | 345 | 364 | soooosssssssssssooss | 25 |
| 613246 | 103087 | 103106 | CCAGAGCTGGGTGGTGTCTT | 51 | 686 | 705 | soooosssssssssssooss | 39 |
| 613181 | 138046 | 138065 | AGCTTCTGGGAGCTGCAGAT | 80 | 3737 | 3756 | soooosssssssssssooss | 340 |
| 613182 | 138083 | 138102 | AGAGGAACCCAGTCTGAGGG | 49 | 3774 | 3793 | soooosssssssssssooss | 341 |
| 613183 | 138116 | 138135 | AGGCTGCGCTGCCCCTCCAG | 68 | 3807 | 3826 | soooosssssssssssooss | 342 |
| 613184 | 138149 | 138168 | AATCCCTGCTGTGGTCGCAG | 63 | 3840 | 3859 | soooosssssssssssooss | 343 |
| 613185 | 138182 | 138201 | TCTAGAGCAGATCCAGGACA | 53 | 3873 | 3892 | soooosssssssssssooss | 344 |
| 613186 | 138215 | 138234 | AAGTCATCCTTCCTCAGGCA | 63 | 3906 | 3925 | soooosssssssssssooss | 345 |
| 613187 | 138248 | 138267 | CAAGGCTTTGGGAACAGTGT | 78 | 3939 | 3958 | soooosssssssssssooss | 346 |
| 613188 | 138250 | 138269 | GTCAAGGCTTTGGGAACAGT | 84 | 3941 | 3960 | soooosssssssssssooss | 347 |
| 613189 | 138281 | 138300 | TTGTGCAAGGTCAGCGGGCT | 75 | 3972 | 3991 | soooosssssssssssooss | 348 |
| 613190 | 138314 | 138333 | CGGCTTCCCTTTTCTCATGG | 75 | 4005 | 4024 | soooosssssssssssooss | 349 |
| 613191 | 138347 | 138366 | TGAGTTTCTTTAGGCAGCAA | 82 | 4038 | 4057 | soooosssssssssssooss | 350 |
| 613192 | 138380 | 138399 | AACCAGAAGTGGCAGAATTG | 47 | 4071 | 4090 | soooosssssssssssooss | 351 |
| 613193 | 138413 | 138432 | CAAGTCCCTCAGGGTTGCCT | 78 | 4104 | 4123 | soooosssssssssssooss | 352 |
| 613194 | 138454 | 138473 | CGAAGCTGCCAGCCCCAGGG | 70 | 4145 | 4164 | soooosssssssssssooss | 353 |
| 613195 | 138487 | 138506 | AGACTTCCTTTCAGGTAAAG | 77 | 4178 | 4197 | soooosssssssssssooss | 354 |
| 613196 | 138503 | 138522 | AGAGTTCTGGGCCCAGAGAC | 58 | 4194 | 4213 | soooosssssssssssooss | 79 |
| 613197 | 138520 | 138539 | AGGGAGGCTCTTGGTGAGA | 35 | 4211 | 4230 | soooosssssssssssooss | 355 |
| 613198 | 138553 | 138572 | ACTTAGGAGAATTGCTGGGA | 75 | 4244 | 4263 | soooosssssssssssooss | 356 |

TABLE 9-continued

Inhibition of Tau mRNA by 5-10-5 MOE gapmers with phosphorothioate
and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 613199 | 138586 | 138605 | CCCACATTTCCTTCTCCTTC | 72 | 4277 | 4296 | sooooosssssssssssooss | 357 |
| 613200 | 138636 | 138655 | ACTGTTGGCAGTAATGAGGG | 71 | 4327 | 4346 | sooooosssssssssssooss | 358 |
| 613201 | 138674 | 138693 | GGAAGAGGAACCGAGGTGCG | 61 | 4365 | 4384 | sooooosssssssssssooss | 359 |
| 613202 | 138707 | 138726 | CATGGTGCTGAAGAGCAGGG | 71 | 4398 | 4417 | sooooosssssssssssooss | 360 |
| 613203 | 138740 | 138759 | GGGAGATCCCAGAGCCTTCC | 53 | 4431 | 4450 | sooooosssssssssssooss | 361 |
| 613204 | 138773 | 138792 | CTTAGGCTGGCCCCAAGAGC | 64 | 4464 | 4483 | sooooosssssssssssooss | 362 |
| 613205 | 138806 | 138825 | TATCTGCCAGCACTGATCAC | 56 | 4497 | 4516 | sooooosssssssssssooss | 363 |
| 613206 | 138839 | 138858 | TTTAAGATCACAAGCCAGCG | 62 | 4530 | 4549 | sooooosssssssssssooss | 364 |
| 613207 | 138872 | 138891 | GAGGAGTGCCCAGCCCTGGG | 54 | 4563 | 4582 | sooooosssssssssssooss | 365 |
| 613208 | 138905 | 138924 | CTGGCTCTGCAGGTGGGAGA | 44 | 4596 | 4615 | sooooosssssssssssooss | 366 |
| 613209 | 138938 | 138957 | TACAGTATATCCTATCTAGC | 57 | 4629 | 4648 | sooooosssssssssssooss | 367 |
| 613210 | 138971 | 138990 | ATAAAGTGAGTCAGCAGCTT | 71 | 4662 | 4681 | sooooosssssssssssooss | 368 |
| 613211 | 139004 | 139023 | TCACCACTGAAGTCAATTTA | 72 | 4695 | 4714 | sooooosssssssssssooss | 369 |
| 613212 | 139037 | 139056 | AGCACAACAAGCAATAGCAA | 80 | 4728 | 4747 | sooooosssssssssssooss | 370 |
| 613213 | 139070 | 139089 | ACTATCTTACACATTCCTCC | 48 | 4761 | 4780 | sooooosssssssssssooss | 371 |
| 613214 | 139103 | 139122 | GCTGCACCCCAAGATCTCCC | 79 | 4794 | 4813 | sooooosssssssssssooss | 372 |
| 613215 | 139136 | 139155 | AAATCATGAAAAGGGTTACG | 61 | 4827 | 4846 | sooooosssssssssssooss | 373 |
| 613216 | 139169 | 139188 | GTGGCTGCTCCCTCCCTCTA | 60 | 4860 | 4879 | sooooosssssssssssooss | 374 |
| 613217 | 139188 | 139207 | CCCAAGGGCCTCTAACTCCG | 64 | 4879 | 4898 | sooooosssssssssssooss | 375 |
| 613218 | 139202 | 139221 | TGGAAAAGAGAAACCCCAAG | 56 | 4893 | 4912 | sooooosssssssssssooss | 376 |
| 613219 | 139229 | 139248 | AGCCAGCTGCCTGGGAAAGC | 63 | 4920 | 4939 | sooooosssssssssssooss | 89 |
| 613220 | 139235 | 139254 | TGAACTAGCCAGCTGCCTGG | 46 | 4926 | 4945 | sooooosssssssssssooss | 377 |
| 613221 | 139268 | 139287 | TATTCCTACGCCTGCACCTG | 54 | 4959 | 4978 | sooooosssssssssssooss | 378 |
| 613222 | 139301 | 139320 | AGAGGGCAGCAGGCCAAAGC | 48 | 4992 | 5011 | sooooosssssssssssooss | 379 |
| 613223 | 139337 | 139356 | TTAGGGAGGCATGATTGTGG | 55 | 5028 | 5047 | sooooosssssssssssooss | 380 |
| 613224 | 139368 | 139387 | CCAACGGCTTAGAGGGAAGG | 61 | 5059 | 5078 | sooooosssssssssssooss | 381 |
| 613225 | 139370 | 139389 | TGCCAACGGCTTAGAGGGAA | 65 | 5061 | 5080 | sooooosssssssssssooss | 382 |
| 613226 | 139403 | 139422 | TGTCTGGAGCCAGTGTGAGA | 56 | 5094 | 5113 | sooooosssssssssssooss | 383 |
| 613227 | 139436 | 139455 | CGAGTGATCTCAGCTCCAAA | 79 | 5127 | 5146 | sooooosssssssssssooss | 384 |
| 613228 | 139502 | 139521 | TGATCACCTCTGCCCTCGCC | 72 | 5193 | 5212 | sooooosssssssssssooss | 385 |
| 613229 | 139535 | 139554 | TGAAGCTGCAGGTCTGTAGA | 57 | 5226 | 5245 | sooooosssssssssssooss | 386 |
| 613230 | 139568 | 139587 | CTTTTCAAAGCTGAAGAGAA | 57 | 5259 | 5278 | sooooosssssssssssooss | 387 |
| 613231 | 139601 | 139620 | AGGTGAGGCTCTAGGCCAGT | 76 | 5292 | 5311 | sooooosssssssssssooss | 388 |
| 613232 | 139636 | 139655 | CAACATGGCAAACTCATGGG | 76 | 5327 | 5346 | sooooosssssssssssooss | 389 |
| 613233 | 139669 | 139688 | ATGGGACTTGCAAGTGCCAG | 83 | 5360 | 5379 | sooooosssssssssssooss | 390 |

TABLE 9-continued

Inhibition of Tau mRNA by 5-10-5 MOE gapmers with phosphorothioate
and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 613234 | 139702 | 139721 | CCTCCCCCCACCCTCAGAAT | 15 | 5393 | 5412 | soooosssssssssssooss | 391 |
| 613235 | 139735 | 139754 | AGACAGAAAGCTAAGCTAAG | 50 | 5426 | 5445 | soooosssssssssssooss | 392 |
| 613236 | 139768 | 139787 | TTAAAACACACAATACACTA | 46 | 5459 | 5478 | soooosssssssssssooss | 393 |
| 613237 | 139801 | 139820 | ACTTTTACAGCAACAGTCAG | 54 | 5492 | 5511 | soooosssssssssssooss | 394 |
| 613238 | 139834 | 139853 | TTTAATCAGAGTAATAACTT | 12 | 5525 | 5544 | soooosssssssssssooss | 395 |

TABLE 10

Inhibition of Tau mRNA by 5-10-5 MOE gapmers with
phosphorothioate and phosphodiester internucleoside
linkages targeting SEQ ID NOs: 5 and 6

| ISIS NO | Target SEQ ID NO | Target Start Site | Sequence | % inhibition | Linkage chemistry | SEQ ID NO |
|---|---|---|---|---|---|---|
| 613239 | 5 | 3 | TGCCCTTCGCGGTCCCTTCG | 2 | soooosssssssssssooss | 396 |
| 613241 | 5 | 424 | CTGTCCCCCAAACCCGTACG | 56 | soooosssssssssssooss | 397 |
| 613248 | 6 | 524 | GCTTCCGCTGTTGGAGTGCT | 62 | soooosssssssssssooss | 398 |

TABLE 11

Inhibition of Tau mRNA by 5-10-5 MOE gapmers with phosphorothioate
and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 433475 | n/a | n/a | TCTTCAGCTTTCAGGCCAGC | 17 | 443 | 462 | ssssssssssssssssssss | 96 |
| 613027 | 5901 | 5920 | GCCCTGCCGCTCGGCCGTCC | 29 | 1 | 20 | soooosssssssssssooss | 399 |
| 613028 | 5934 | 5953 | TTCTCCTCCGGCCACTAGTG | 22 | 34 | 53 | soooosssssssssssooss | 400 |
| 613029 | 5987 | 6006 | GAACGCGAGCCTCCCCAGGG | 1 | 87 | 106 | soooosssssssssssooss | 401 |
| 613030 | 6020 | 6039 | GAGGCCGGCGGGCGGCGCAG | 2 | 120 | 139 | soooosssssssssssooss | 402 |
| 613031 | 6053 | 6072 | GAGGGCGCGCGCCGGCGAAG | 0 | 153 | 172 | soooosssssssssssooss | 403 |
| 613032 | 6086 | 6105 | TTGGTGCCGGAGCTGGTGGG | 54 | 186 | 205 | soooosssssssssssooss | 404 |
| 613033 | 6119 | 6138 | GGCAGAAGGTGGGCGGTGGC | 74 | 219 | 238 | soooosssssssssssooss | 405 |
| 613034 | 6185 | 6204 | TGATAGTCGACAGAGGCGAG | 71 | 285 | 304 | soooosssssssssssooss | 406 |
| 613035 | 73867 | 73886 | CACTTCGAACTCCTGGCGGG | 67 | 333 | 352 | soooosssssssssssooss | 98 |
| 613036 | 73869 | 73888 | ATCACTTCGAACTCCTGGCG | 72 | 335 | 354 | soooosssssssssssooss | 99 |
| 613037 | 73871 | 73890 | CCATCACTTCGAACTCCTGG | 69 | 337 | 356 | soooosssssssssssooss | 100 |
| 613412 | 73879 | 73898 | GTGATCTTCCATCACTTCGA | 72 | 345 | 364 | soooosssssssssssooss | 25 |

TABLE 11-continued

Inhibition of Tau mRNA by 5-10-5 MOE gapmers with phosphorothioate
and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 613038 | 73906 | 73925 | CCTGTCCCCAACCCGTACG | 44 | 372 | 391 | sooooosssssssssssooss | 104 |
| 613039 | 73932 | 73951 | TGCATGGTGTAGCCCCCTG | 80 | 398 | 417 | sooooosssssssssssooss | 117 |
| 613040 | 73934 | 73953 | GGTGCATGGTGTAGCCCCC | 73 | 400 | 419 | sooooosssssssssssooss | 118 |
| 613041 | 73939 | 73958 | GTCTTGGTGCATGGTGTAGC | 77 | 405 | 424 | sooooosssssssssssooss | 407 |
| 613042 | 73958 | 73977 | CGTCCGTGTCACCCTCTTGG | 79 | 424 | 443 | sooooosssssssssssooss | 123 |
| 613044 | 83397 | 83416 | CCTCAGATCCGTCCTCAGTG | 67 | n/a | n/a | sooooosssssssssssooss | 408 |
| 613045 | 83430 | 83449 | TGCTCTTAGCATCAGAGGTT | 89 | n/a | n/a | sooooosssssssssssooss | 409 |
| 613046 | 85902 | 85921 | CTAAGGGTGCTGTCACATCT | 69 | n/a | n/a | sooooosssssssssssooss | 410 |
| 613047 | 85934 | 85953 | GGCAGCCTGCTTGCCGGGAG | 51 | n/a | n/a | sooooosssssssssssooss | 29 |
| 613048 | 85935 | 85954 | CGGCAGCCTGCTTGCCGGGA | 51 | n/a | n/a | sooooosssssssssssooss | 411 |
| 613049 | 85968 | 85987 | TGGTTCCTTCTGGGATCTCC | 76 | n/a | n/a | sooooosssssssssssooss | 412 |
| 613051 | 94719 | 94738 | CTCGGAGGAAGCCTTCCTGG | 53 | n/a | n/a | sooooosssssssssssooss | 413 |
| 613052 | 94752 | 94771 | TGAGCTGGTGGCTCAGACCT | 41 | n/a | n/a | sooooosssssssssssooss | 414 |
| 613053 | 94825 | 94844 | CCTGTCCCCGAAGGTTGGCG | 61 | n/a | n/a | sooooosssssssssssooss | 415 |
| 613054 | 94875 | 94894 | GGTGCTTGAGCAGCTCAGGG | 70 | n/a | n/a | sooooosssssssssssooss | 416 |
| 613055 | 94908 | 94927 | GCGGCCCCTCCTGGTGCAGG | 47 | n/a | n/a | sooooosssssssssssooss | 417 |
| 613056 | 94941 | 94960 | CCGGCCTCTCTTTGCCCCCT | 31 | n/a | n/a | sooooosssssssssssooss | 418 |
| 613057 | 94974 | 94993 | CGTCGCGGTCTTCATCCACC | 42 | n/a | n/a | sooooosssssssssssooss | 419 |
| 613058 | 95038 | 95057 | GGCCGCCCATCTTGGGCTGG | 0 | n/a | n/a | sooooosssssssssssooss | 420 |
| 613059 | 95071 | 95090 | ATGCTGGTGGCTTCTCTGGC | 53 | n/a | n/a | sooooosssssssssssooss | 421 |
| 613060 | 95098 | 95117 | ATGGCACCCTCCGCTGGGAA | 39 | n/a | n/a | sooooosssssssssssooss | 422 |
| 613061 | 95121 | 95140 | AGAGGAAATCCACAGGGAGG | 30 | n/a | n/a | sooooosssssssssssooss | 33 |
| 613062 | 95154 | 95173 | GCTCTGAGGCTGGGATCTCT | 70 | n/a | n/a | sooooosssssssssssooss | 423 |
| 613063 | 95187 | 95206 | GCCCTTTGGCCCGCCCTACA | 67 | n/a | n/a | sooooosssssssssssooss | 424 |
| 613064 | 95235 | 95254 | CGTTGGGTGTGATTTCCACG | 61 | n/a | n/a | sooooosssssssssssooss | 425 |
| 613065 | 95268 | 95287 | AATGCTCCTCCGAGTGCGCC | 85 | n/a | n/a | sooooosssssssssssooss | 426 |
| 613066 | 95313 | 95332 | CCTCTGGCCCCTCTCCAGGG | 43 | n/a | n/a | sooooosssssssssssooss | 427 |
| 613067 | 95346 | 95365 | CTTTTGTGTCCTCTCCCAAA | 42 | n/a | n/a | sooooosssssssssssooss | 428 |
| 613068 | 95379 | 95398 | GCTGCTTTTCAGAGGGCTCT | 51 | n/a | n/a | sooooosssssssssssooss | 429 |
| 613069 | 95412 | 95431 | GGCTGACGGGCTTCCCCCGC | 61 | n/a | n/a | sooooosssssssssssooss | 430 |
| 613070 | 95429 | 95448 | TTTGAGTTGAGGGACCCGGC | 33 | n/a | n/a | sooooosssssssssssooss | 431 |
| 613073 | 98559 | 98578 | GCTTTTACTGACCATGCGAG | 79 | 522 | 541 | sooooosssssssssssooss | 124 |
| 613074 | 98581 | 98600 | CATCGCTTCCAGTCCCGTCT | 78 | 544 | 563 | sooooosssssssssssooss | 134 |
| 613075 | 98587 | 98606 | TTTTGTCATCGCTTCCAGTC | 35 | 550 | 569 | sooooosssssssssssooss | 137 |
| 613076 | 101406 | 101425 | AAGGTTTTAGCAGAGGAACG | 63 | n/a | n/a | sooooosssssssssssooss | 37 |
| 613077 | 101457 | 101476 | TCTGAGCTACCAGGAGTGGG | 65 | n/a | n/a | sooooosssssssssssooss | 432 |

TABLE 11-continued

Inhibition of Tau mRNA by 5-10-5 MOE gapmers with phosphorothioate
and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 613078 | 101491 | 101510 | GCACACAGCAGGGCTGGAGG | 68 | n/a | n/a | sooooosssssssssssooss | 433 |
| 613079 | 101501 | 101520 | GTGGCTCTGGGCACACAGCA | 77 | n/a | n/a | sooooosssssssssssooss | 192 |
| 613080 | 101507 | 101526 | AGGAAGGTGGCTCTGGGCAC | 69 | n/a | n/a | sooooosssssssssssooss | 38 |
| 613081 | 101537 | 101556 | GGGAAGTGACAGAAGAGACG | 46 | n/a | n/a | sooooosssssssssssooss | 434 |
| 613082 | 101570 | 101589 | GTTTCATCTCCTTTGCTCCA | 57 | n/a | n/a | sooooosssssssssssooss | 435 |
| 613083 | 102995 | 103014 | CCGCGGTGTGGCGATCTTCG | 9 | 594 | 613 | sooooosssssssssssooss | 436 |
| 613084 | 103028 | 103047 | GGCCTGGCCCTTCTGGCCTG | 14 | 627 | 646 | sooooosssssssssssooss | 437 |
| 613085 | 103075 | 103094 | GGTGTCTTTGGAGCGGGCGG | 37 | 674 | 693 | sooooosssssssssssooss | 146 |
| 613086 | 105445 | 105464 | CTTCTCTGGACTTGCTTAGT | 45 | n/a | n/a | sooooosssssssssssooss | 438 |
| 613087 | 105475 | 105494 | CTCTCAGATCTGGGCCCTGC | 41 | n/a | n/a | sooooosssssssssssooss | 439 |
| 613088 | 105478 | 105497 | CCTCTCTCAGATCTGGGCCC | 49 | n/a | n/a | sooooosssssssssssooss | 440 |
| 613089 | 107932 | 107951 | TAGCCGCTGCGATCCCCTGA | 19 | 719 | 738 | sooooosssssssssssooss | 441 |
| 613090 | 107968 | 107987 | CGGCTGCCGGGAGTGCCTGG | 31 | 755 | 774 | sooooosssssssssssooss | 159 |
| 613091 | 108021 | 108040 | CCACCTTCTTGGGCTCCCGG | 17 | 808 | 827 | sooooosssssssssssooss | 442 |
| 613092 | 108040 | 108059 | GGTGGAGTACGGACCACTGC | 20 | 827 | 846 | sooooosssssssssssooss | 40 |
| 613093 | 108054 | 108073 | AAGACGGCGACTTGGGTGGA | 0 | 841 | 860 | sooooosssssssssssooss | 41 |
| 613094 | 108101 | 108120 | CAGGTCTGGCATGGGCACGG | 67 | 888 | 907 | sooooosssssssssssooss | 443 |
| 613095 | 108134 | 108153 | CTCAGTGGAGCCGATCTTGG | 31 | 921 | 940 | sooooosssssssssssooss | 199 |
| 613096 | 108167 | 108186 | CACCTTCCCGCCTCCCGGCT | 47 | 954 | 973 | sooooosssssssssssooss | 444 |
| 613097 | 121845 | 121864 | GTTGCTAAGATCCAGCTTCT | 49 | n/a | n/a | sooooosssssssssssooss | 445 |
| 613098 | 121865 | 121884 | GAGCCACACTTGGACTGGAC | 85 | n/a | n/a | sooooosssssssssssooss | 47 |
| 613099 | 121878 | 121897 | GATATTATCCTTTGAGCCAC | 88 | n/a | n/a | sooooosssssssssssooss | 446 |
| 613101 | 125784 | 125803 | GGTCACCTTGCTCAGGTCAA | 68 | 993 | 1012 | sooooosssssssssssooss | 447 |
| 613102 | 125817 | 125836 | ATGATGGATGTTGCCTAATG | 14 | 1026 | 1045 | sooooosssssssssssooss | 448 |
| 613103 | 130141 | 130160 | ATTTTACTTCCACCTGGCCA | 22 | 1057 | 1076 | sooooosssssssssssooss | 51 |

TABLE 12

Inhibition of Tau mRNA by 5-10-5 MOE gapmers with
phosphorothioate and phosphodiester internucleoside
linkages targeting SEQ ID NOs: 6 and 7

| ISIS NO | Target SEQ ID NO | Target Start Site | Sequence | % inhibition | Linkage chemistry | SEQ ID NO |
|---|---|---|---|---|---|---|
| 613043 | 6 | 442 | GAGATTCTTTCAGGCCAGCG | 17 | soooosssssssssssooss | 449 |
| 613050 | 7 | 685 | TTTCAGGCTCTTGGGTCACG | 0 | soooosssssssssssooss | 450 |
| 613071 | 7 | 1430 | GCTTTGAGTTGAGGGACCCG | 23 | soooosssssssssssooss | 451 |

TABLE 12-continued

Inhibition of Tau mRNA by 5-10-5 MOE gapmers with phosphorothioate and phosphodiester internucleoside linkages targeting SEQ ID NOs: 6 and 7

| ISIS NO | Target SEQ ID NO | Target Start Site | Sequence | % inhibition | Linkage chemistry | SEQ ID NO |
|---|---|---|---|---|---|---|
| 613072 | 7 | 1444 | TACTGACCATGCGAGCTTTG | 73 | soooosssssssssssooss | 177 |
| 613100 | 7 | 2178 | TATTTGCACACTGCCGCCTC | 13 | soooosssssssssssooss | 452 |

TABLE 13

Inhibition of Tau mRNA by 5-10-5 MOE gapmers with phosphorothioate and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 433475 | n/a | n/a | TCTTCAGCTTTCAGGCCAGC | 23 | 443 | 462 | ssssssssssssssssssss | 96 |
| 613412 | 73879 | 73898 | GTGATCTTCCATCACTTCGA | 76 | 345 | 364 | soooosssssssssssooss | 25 |
| 613104 | 130143 | 130162 | AGATTTTACTTCCACCTGGC | 59 | 1059 | 1078 | soooosssssssssssooss | 453 |
| 613105 | 130176 | 130195 | CGACTGGACTCTGTCCTTGA | 47 | 1092 | 1111 | soooosssssssssssooss | 454 |
| 613106 | 130225 | 130244 | TATTTCCTCCGCCAGGGACG | 90 | 1141 | 1160 | soooosssssssssssooss | 455 |
| 613107 | 135483 | 135502 | CGCGGAAGGTCAGCTTGTGG | 43 | 1174 | 1193 | soooosssssssssssooss | 456 |
| 613108 | 135516 | 135535 | CCGCCCCGTGGTCTGTCTTG | 44 | 1207 | 1226 | soooosssssssssssooss | 457 |
| 613109 | 135549 | 135568 | CCCCAGACACCACTGGCGAC | 36 | 1240 | 1259 | soooosssssssssssooss | 458 |
| 613110 | 135590 | 135609 | GCCGGTGGAGGAGACATTGC | 51 | 1281 | 1300 | soooosssssssssssooss | 459 |
| 613111 | 135654 | 135673 | CCAGGGAGGCAGACACCTCG | 61 | 1345 | 1364 | soooosssssssssssooss | 245 |
| 613112 | 135697 | 135716 | AATTATTGACCGCCCCAGGG | 33 | 1388 | 1407 | soooosssssssssssooss | 460 |
| 613113 | 135730 | 135749 | TTTTTCCACACTCTCTCATT | 41 | 1421 | 1440 | soooosssssssssssooss | 461 |
| 613114 | 135783 | 135802 | AACTGCGAGGAGCAGCTGGG | 51 | 1474 | 1493 | soooosssssssssssooss | 462 |
| 613115 | 135786 | 135805 | CCGAACTGCGAGGAGCAGCT | 78 | 1477 | 1496 | soooosssssssssssooss | 248 |
| 613116 | 135816 | 135835 | CAAAAGCAGGTTAAGTGATT | 28 | 1507 | 1526 | soooosssssssssssooss | 463 |
| 613117 | 135849 | 135868 | CTGATTTTGAAGTCCCGAGC | 69 | 1540 | 1559 | soooosssssssssssooss | 464 |
| 613118 | 135869 | 135888 | ATTTGCTCTTACTCCCATCA | 80 | 1560 | 1579 | soooosssssssssssooss | 465 |
| 613119 | 135882 | 135901 | TTGGAAAGATGAAATTTGCT | 52 | 1573 | 1592 | soooosssssssssssooss | 466 |
| 613120 | 135948 | 135967 | TGTTGGATGTGGCCATGTTT | 63 | 1639 | 1658 | soooosssssssssssooss | 467 |
| 613121 | 136049 | 136068 | GTCCCTTGAAATCCCCCAGA | 45 | 1740 | 1759 | soooosssssssssssooss | 468 |
| 613122 | 136082 | 136101 | CCACAACAGGGCCAGAGGTG | 55 | 1773 | 1792 | soooosssssssssssooss | 469 |
| 613123 | 136115 | 136134 | TCCTTTGTTGCTGCCACTGC | 59 | 1806 | 1825 | soooosssssssssssooss | 470 |
| 613124 | 136148 | 136167 | GCCTGTGGCTCCACGAACAC | 72 | 1839 | 1858 | soooosssssssssssooss | 471 |
| 613125 | 136181 | 136200 | CCCCGTCACACTCACACAAG | 43 | 1872 | 1891 | soooosssssssssssooss | 472 |
| 613126 | 136214 | 136233 | GGCCTCCCCCGTGGCCTCCC | 37 | 1905 | 1924 | soooosssssssssssooss | 473 |
| 613127 | 136247 | 136266 | TGCTTCCTCTCCCCTCTGCC | 41 | 1938 | 1957 | soooosssssssssssooss | 474 |
| 613128 | 136295 | 136314 | GATGTCTACTCTCCAGCACG | 32 | 1986 | 2005 | soooosssssssssssooss | 475 |

TABLE 13-continued

Inhibition of Tau mRNA by 5-10-5 MOE gapmers with phosphorothioate
and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 613129 | 136328 | 136347 | ATAGGCCTTGGCTCTCCCAG | 73 | 2019 | 2038 | sooooosssssssssssooss | 476 |
| 613130 | 136361 | 136380 | AGGACAGGCGGCCGCTCAGA | 46 | 2052 | 2071 | sooooosssssssssssooss | 477 |
| 613131 | 136394 | 136413 | TGACCCACAGCAGGCCCCCA | 14 | 2085 | 2104 | sooooosssssssssssooss | 478 |
| 613132 | 136427 | 136446 | CTCCCACAGGCTGCCCTGCA | 46 | 2118 | 2137 | sooooosssssssssssooss | 479 |
| 613133 | 136460 | 136479 | CAGCTTGCCTTCTCTTTTTA | 58 | 2151 | 2170 | sooooosssssssssssooss | 480 |
| 613134 | 136491 | 136510 | GGAGGTCATCCACGAAGTGC | 45 | 2182 | 2201 | sooooosssssssssssooss | 61 |
| 613135 | 136493 | 136512 | AAGGAGGTCATCCACGAAGT | 41 | 2184 | 2203 | sooooosssssssssssooss | 481 |
| 613136 | 136515 | 136534 | GACATCAAGGTCAGTCTTTT | 80 | 2206 | 2225 | sooooosssssssssssooss | 482 |
| 613137 | 136541 | 136560 | AGGGAGGAAGAGGCCAGCGC | 60 | 2232 | 2251 | sooooosssssssssssooss | 483 |
| 613138 | 136574 | 136593 | AGCCCTCAACTCAGGCCCC | 53 | 2265 | 2284 | sooooosssssssssssooss | 484 |
| 613139 | 136607 | 136626 | TCAATAAAACAGGGTTTCTG | 38 | 2298 | 2317 | sooooosssssssssssooss | 485 |
| 613140 | 136640 | 136659 | CAAAATCATGGCAGCAGTTC | 26 | 2331 | 2350 | sooooosssssssssssooss | 486 |
| 613141 | 136673 | 136692 | GTTAGCCCTAAAGTCCCAGG | 76 | 2364 | 2383 | sooooosssssssssssooss | 487 |
| 613142 | 136706 | 136725 | CCCAAGAGGCACAAGTCCTT | 57 | 2397 | 2416 | sooooosssssssssssooss | 488 |
| 613143 | 136739 | 136758 | CAGTGGCCCAGGCTTGGAAA | 63 | 2430 | 2449 | sooooosssssssssssooss | 489 |
| 613144 | 136748 | 136767 | CAGAGATGCCAGTGGCCCAG | 43 | 2439 | 2458 | sooooosssssssssssooss | 67 |
| 613145 | 136772 | 136791 | TGCCTCCCAGACCCCCACAC | 23 | 2463 | 2482 | sooooosssssssssssooss | 490 |
| 613146 | 136805 | 136824 | AGTGGCCGTGGGAAGGACAG | 17 | 2496 | 2515 | sooooosssssssssssooss | 491 |
| 613147 | 136838 | 136857 | ACAACAGCACAGCGGCGCAG | 61 | 2529 | 2548 | sooooosssssssssssooss | 492 |
| 613148 | 136845 | 136864 | ACGGCAGACAACAGCACAGC | 59 | 2536 | 2555 | sooooosssssssssssooss | 493 |
| 613149 | 136899 | 136918 | GAATTCGGGACATTGTGACG | 42 | 2590 | 2609 | sooooosssssssssssooss | 494 |
| 613150 | 136933 | 136952 | CAGGGTCATTACTGAGAAGG | 39 | 2624 | 2643 | sooooosssssssssssooss | 495 |
| 613151 | 136966 | 136985 | CTCAGTATGGAGTAGGTACC | 52 | 2657 | 2676 | sooooosssssssssssooss | 496 |
| 613152 | 136999 | 137018 | TGTGCCTGGACTTTGCCTTC | 61 | 2690 | 2709 | sooooosssssssssssooss | 497 |
| 613153 | 137032 | 137051 | GGAACTGAGAGTGAGAGGCT | 62 | 2723 | 2742 | sooooosssssssssssooss | 498 |
| 613154 | 137077 | 137096 | GAATCAGATCATGAGATTCG | 30 | 2768 | 2787 | sooooosssssssssssooss | 499 |
| 613155 | 137110 | 137129 | CACATCTGTGACGGGAGGAG | 26 | 2801 | 2820 | sooooosssssssssssooss | 500 |
| 613156 | 137143 | 137162 | CACCTAGGGTCACAGCTGAG | 33 | 2834 | 2853 | sooooosssssssssssooss | 501 |
| 613157 | 137176 | 137195 | GAAAGGGCTCTCTCCATGTC | 54 | 2867 | 2886 | sooooosssssssssssooss | 502 |
| 613158 | 137214 | 137233 | GTGGGCTCAGCACAGGAAGG | 23 | 2905 | 2924 | sooooosssssssssssooss | 503 |
| 613159 | 137229 | 137248 | ACCCAGCCTGCTGCTGTGGG | 36 | 2920 | 2939 | sooooosssssssssssooss | 504 |
| 613160 | 137247 | 137266 | ACCACTGACAACCAAGACAC | 22 | 2938 | 2957 | sooooosssssssssssooss | 505 |
| 613161 | 137280 | 137299 | GCCCTGGGTGCCTTGCCCTT | 53 | 2971 | 2990 | sooooosssssssssssooss | 506 |
| 613162 | 137322 | 137341 | ACAAGCTAGGGTGCAAGTGG | 47 | 3013 | 3032 | sooooosssssssssssooss | 507 |
| 613163 | 137364 | 137383 | GGAGCTGAGCAGCGGGCTGG | 45 | 3055 | 3074 | sooooosssssssssssooss | 508 |

TABLE 13-continued

Inhibition of Tau mRNA by 5-10-5 MOE gapmers with phosphorothioate and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 613164 | 137401 | 137420 | CCCTTTGTCGGGTGTGGAGG | 8 | 3092 | 3111 | sooosssssssssssooss | 509 |
| 613165 | 137453 | 137472 | TGGCTTCCAGCTGGGACTGG | 65 | 3144 | 3163 | sooosssssssssssooss | 510 |
| 613166 | 137486 | 137505 | ATATGTTCAGCTGCTCCAGC | 58 | 3177 | 3196 | sooosssssssssssooss | 511 |
| 613167 | 137529 | 137548 | ACTCAACAGGGTGCAGATGG | 54 | 3220 | 3239 | sooosssssssssssooss | 512 |
| 613168 | 137562 | 137581 | GAATCCAAGCATAAACAGAC | 55 | 3253 | 3272 | sooosssssssssssooss | 513 |
| 613169 | 137595 | 137614 | TTTTTTTCTTTTCACTATCA | 34 | 3286 | 3305 | sooosssssssssssooss | 514 |
| 613170 | 137629 | 137648 | AGCATTTCAAGATACATGCG | 59 | 3320 | 3339 | sooosssssssssssooss | 515 |
| 613171 | 137692 | 137711 | CACACGAGTCCCAGTGTGGG | 11 | 3383 | 3402 | sooosssssssssssooss | 516 |
| 613172 | 137761 | 137780 | TTGGGTCCCAGGTGCTGAGG | 40 | 3452 | 3471 | sooosssssssssssooss | 517 |
| 613173 | 137794 | 137813 | ACGGCCTCCTTAGCTGCTAG | 73 | 3485 | 3504 | sooosssssssssssooss | 518 |
| 613174 | 137827 | 137846 | TAATCCTGTGCTTCAGGCCT | 32 | 3518 | 3537 | sooosssssssssssooss | 519 |
| 613175 | 137881 | 137900 | TGACACAGGGAGCCCCAAGG | 40 | 3572 | 3591 | sooosssssssssssooss | 520 |
| 613176 | 137914 | 137933 | AGCCAGACCAGCCACAAGAC | 16 | 3605 | 3624 | sooosssssssssssooss | 521 |
| 613177 | 137947 | 137966 | GCTATGACCAGAGAGAACCA | 29 | 3638 | 3657 | sooosssssssssssooss | 522 |
| 613178 | 137967 | 137986 | GGACTGCCATGAGACTTCGG | 26 | 3658 | 3677 | sooosssssssssssooss | 523 |
| 613179 | 137980 | 137999 | TAAGCCTCCTTTGGGACTGC | 64 | 3671 | 3690 | sooosssssssssssooss | 524 |
| 613180 | 138013 | 138032 | AGTGGCTTCCTTTTTCTTGT | 69 | 3704 | 3723 | sooosssssssssssooss | 525 |

TABLE 14

Inhibition of Tau mRNA by 5-10-5 MOE gapmers with phosphorothioate and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 433475 | n/a | n/a | TCTTCAGCTTTCAGGCCAGC | 23 | 433 | 452 | sssssssssssssssssss | 96 |
| 613258 | 18371 | 18390 | GGCAATGCCTGGAAGAAACT | 75 | n/a | n/a | sooosssssssssssooss | 526 |
| 613259 | 18411 | 18430 | CGCTGGTGAGAGTGTGACTG | 69 | n/a | n/a | sooosssssssssssooss | 527 |
| 613260 | 18449 | 18468 | ATCCGAGGGTGAGATGATAA | 75 | n/a | n/a | sooosssssssssssooss | 528 |
| 613261 | 19611 | 19630 | AATAATTTCTCCAGGCTCAT | 62 | n/a | n/a | sooosssssssssssooss | 529 |
| 613262 | 20955 | 20974 | GCTGACTTCGATTTGTTATT | 84 | n/a | n/a | sooosssssssssssooss | 530 |
| 613263 | 22139 | 22158 | TATCATATGGCACAAATTCT | 32 | n/a | n/a | sooosssssssssssooss | 531 |
| 613264 | 23662 | 23681 | CTACCTGGGACCACACCTTA | 61 | n/a | n/a | sooosssssssssssooss | 532 |
| 613265 | 25046 | 25065 | GGGTGGAGAGCCTGATGGTC | 47 | n/a | n/a | sooosssssssssssooss | 533 |
| 613266 | 25418 | 25437 | CTGTGAGCATCATGAAAGCC | 56 | n/a | n/a | sooosssssssssssooss | 534 |
| 613267 | 25606 | 25625 | TTTTATTATGAGGGAGATCA | 48 | n/a | n/a | sooosssssssssssooss | 535 |
| 613268 | 26186 | 26205 | AATAGTAGAGAAATGGAAAT | 39 | n/a | n/a | sooosssssssssssooss | 536 |

TABLE 14-continued

Inhibition of Tau mRNA by 5-10-5 MOE gapmers with phosphorothioate and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 613269 | 26690 | 26709 | TAACATGACAGGGTTAGGCC | 67 | n/a | n/a | sooooosssssssssssooss | 537 |
| 613270 | 26917 | 26936 | GCCCACACACATGCTCATGC | 57 | n/a | n/a | sooooosssssssssssooss | 538 |
| 613271 | 27160 | 27179 | TGTGTTCAGTTACATGCCTT | 82 | n/a | n/a | sooooosssssssssssooss | 539 |
| 613272 | 27569 | 27588 | GACCACCATGGTGGGCTGAC | 39 | n/a | n/a | sooooosssssssssssooss | 540 |
| 613273 | 28227 | 28246 | GGCACCTCTCTGCAGACTTT | 85 | n/a | n/a | sooooosssssssssssooss | 541 |
| 613274 | 30102 | 30121 | TGCTTCACACACCACAATGG | 60 | n/a | n/a | sooooosssssssssssooss | 542 |
| 613275 | 31769 | 31788 | AACATTGCCGAGCACCAGCC | 63 | n/a | n/a | sooooosssssssssssooss | 543 |
| 613276 | 31832 | 31851 | GACTCAGGAACATGTTAGCT | 70 | n/a | n/a | sooooosssssssssssooss | 544 |
| 613277 | 32045 | 32064 | CACGGCTCAGCAGAGGAGAC | 23 | n/a | n/a | sooooosssssssssssooss | 545 |
| 613278 | 32324 | 32343 | GCTGCTATCCTTCCTGGGCC | 57 | n/a | n/a | sooooosssssssssssooss | 546 |
| 613279 | 32760 | 32779 | GGAAATGAAAGCTTCCCACG | 61 | n/a | n/a | sooooosssssssssssooss | 547 |
| 613280 | 33359 | 33378 | AACAGTCAGAATACCCCCAA | 72 | n/a | n/a | sooooosssssssssssooss | 548 |
| 613281 | 34056 | 34075 | TATAGGTAGAATATAAAACT | 17 | n/a | n/a | sooooosssssssssssooss | 549 |
| 613282 | 35266 | 35285 | TATGAACAAAACTGCAGGAC | 45 | n/a | n/a | sooooosssssssssssooss | 550 |
| 613283 | 35839 | 35858 | AGCCTCCAGAGTGACAGGTG | 63 | n/a | n/a | sooooosssssssssssooss | 551 |
| 613284 | 36223 | 36242 | CCATAAGCCACTCCTGGTTG | 0 | n/a | n/a | sooooosssssssssssooss | 552 |
| 613285 | 36410 | 36429 | CAGCTTGGAAGATACAGGAG | 63 | n/a | n/a | sooooosssssssssssooss | 553 |
| 613286 | 38647 | 38666 | CAAACTTAAGAAAAGTTGCA | 67 | n/a | n/a | sooooosssssssssssooss | 554 |
| 613287 | 39104 | 39123 | TGCTGGCAAAGAAGACAGGA | 69 | n/a | n/a | sooooosssssssssssooss | 555 |
| 613288 | 40506 | 40525 | CCACTGATGGCCGGGTGCAG | 27 | n/a | n/a | sooooosssssssssssooss | 556 |
| 613289 | 42727 | 42746 | TGGGTGTCAAATGGCTGGCT | 55 | n/a | n/a | sooooosssssssssssooss | 557 |
| 613290 | 42955 | 42974 | TAGAAAGCTATTTAATAAAT | 0 | n/a | n/a | sooooosssssssssssooss | 558 |
| 613291 | 43109 | 43128 | AGCCGTACATCAATGGTACA | 71 | n/a | n/a | sooooosssssssssssooss | 559 |
| 613292 | 46627 | 46646 | GGCCCTACCATGGTCGATTT | 57 | n/a | n/a | sooooosssssssssssooss | 560 |
| 613293 | 47399 | 47418 | ATCAGTGCCAGAGACAGAGG | 5 | n/a | n/a | sooooosssssssssssooss | 561 |
| 613294 | 48115 | 48134 | TATTATTAACGAACAAAAAA | 0 | n/a | n/a | sooooosssssssssssooss | 562 |
| 613295 | 48223 | 48242 | AGAGCAATACTTTGTGCTTA | 51 | n/a | n/a | sooooosssssssssssooss | 563 |
| 613296 | 48608 | 48627 | AGACTCCTCAAATGTGCGCC | 53 | n/a | n/a | sooooosssssssssssooss | 564 |
| 613297 | 49204 | 49223 | GAATGACGGCCGCCTCCTCT | 39 | n/a | n/a | sooooosssssssssssooss | 565 |
| 613298 | 49696 | 49715 | TATGGAGGGCTTCTGGCCTC | 18 | n/a | n/a | sooooosssssssssssooss | 566 |
| 613299 | 51161 | 51180 | GAGAAAGAGCGAGTAATTAG | 44 | n/a | n/a | sooooosssssssssssooss | 567 |
| 613300 | 52250 | 52269 | TAGCTAGAAACTGTGTCCCT | 41 | n/a | n/a | sooooosssssssssssooss | 568 |
| 613301 | 53908 | 53927 | CTGTGAGATCATCCCCTGGT | 51 | n/a | n/a | sooooosssssssssssooss | 569 |
| 613302 | 54457 | 54476 | CAGCGCAGTGCAGGGAGTCA | 41 | n/a | n/a | sooooosssssssssssooss | 570 |
| 613303 | 55975 | 55994 | GGGTACACAGAGAGGCCACT | 53 | n/a | n/a | sooooosssssssssssooss | 571 |

TABLE 14-continued

Inhibition of Tau mRNA by 5-10-5 MOE gapmers with phosphorothioate
and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 613304 | 56155 | 56174 | GAACGATGCACTGCCTTGGC | 54 | n/a | n/a | soooosssssssssssooss | 572 |
| 613305 | 57402 | 57421 | CACCATATTACACCAGTTGT | 60 | n/a | n/a | soooosssssssssssooss | 573 |
| 613306 | 57696 | 57715 | CTGAAATGAATCCCCTGAAC | 0 | n/a | n/a | soooosssssssssssooss | 574 |
| 613307 | 57733 | 57752 | GTGTCCACGAATGCCCCTGG | 40 | n/a | n/a | soooosssssssssssooss | 575 |
| 613308 | 58392 | 58411 | ACGGATGGTTGCTGCTGATG | 47 | n/a | n/a | soooosssssssssssooss | 576 |
| 613309 | 61917 | 61936 | GTCCCTTTTGCTCCCAAAGA | 18 | n/a | n/a | soooosssssssssssooss | 577 |
| 613310 | 62489 | 62508 | CAGTCTTTTAATAAGTGAAA | 50 | n/a | n/a | soooosssssssssssooss | 578 |
| 613311 | 63219 | 63238 | TTAGCTAAATTGAGGCCCGG | 31 | n/a | n/a | soooosssssssssssooss | 579 |
| 613312 | 63257 | 63276 | GGAAAGGTATTGCCTCCTGA | 42 | n/a | n/a | soooosssssssssssooss | 580 |
| 613313 | 63627 | 63646 | GGTGACTACGCAGCCTGGAC | 57 | n/a | n/a | soooosssssssssssooss | 581 |
| 613314 | 64559 | 64578 | TTCAGGGCAATCCTTGAGGT | 41 | n/a | n/a | soooosssssssssssooss | 582 |
| 613315 | 64872 | 64891 | TGCTAATGCTTTGGGACCTA | 44 | n/a | n/a | soooosssssssssssooss | 583 |
| 613316 | 66922 | 66941 | TGGGTAGAGAGCAACTGTTC | 32 | n/a | n/a | soooosssssssssssooss | 584 |
| 613317 | 67104 | 67123 | ACACCCCTTCTCTGCACATC | 25 | n/a | n/a | soooosssssssssssooss | 585 |
| 613318 | 68893 | 68912 | CTGCTAGAGTTCGCCAACAG | 59 | n/a | n/a | soooosssssssssssooss | 586 |
| 613319 | 69457 | 69476 | TCTTATTCTCTAGGTGGGCT | 70 | n/a | n/a | soooosssssssssssooss | 587 |
| 613320 | 70922 | 70941 | CAGTGCAAGTGGGTATGAAG | 30 | n/a | n/a | soooosssssssssssooss | 588 |
| 613321 | 70928 | 70947 | CAGATGCAGTGCAAGTGGGT | 44 | n/a | n/a | soooosssssssssssooss | 589 |
| 613322 | 71310 | 71329 | GAAAAACTTTGTCCATAATT | 41 | n/a | n/a | soooosssssssssssooss | 590 |
| 613323 | 71665 | 71684 | TAATGAATGTATAACAGAAA | 0 | n/a | n/a | soooosssssssssssooss | 591 |
| 613324 | 71702 | 71721 | AAAAGGCAGATACTTTGTGG | 56 | n/a | n/a | soooosssssssssssooss | 592 |
| 613325 | 72456 | 72475 | CAGAGGTGTGAAAGTAAAAG | 0 | n/a | n/a | soooosssssssssssooss | 593 |
| 613326 | 72566 | 72585 | CAGCTAAAGCTTTGTGAACA | 31 | n/a | n/a | soooosssssssssssooss | 594 |
| 613327 | 72612 | 72631 | TGCAGCCCAGGTGAGCCAGC | 49 | n/a | n/a | soooosssssssssssooss | 595 |
| 613328 | 73748 | 73767 | GCCTCTCCTCCCAGTTCATG | 12 | n/a | n/a | soooosssssssssssooss | 596 |
| 613329 | 75140 | 75159 | GTTTTCTTATTTTTAGCATT | 87 | n/a | n/a | soooosssssssssssooss | 597 |
| 613330 | 76340 | 76359 | GGAGGGACGAGAAACAGCAG | 0 | n/a | n/a | soooosssssssssssooss | 598 |
| 613331 | 79041 | 79060 | AGCTTCCAGCATGAACATAG | 77 | n/a | n/a | soooosssssssssssooss | 599 |
| 613332 | 79971 | 79990 | GAGCCCTGATATGATAGAGG | 57 | n/a | n/a | soooosssssssssssooss | 600 |
| 613333 | 80360 | 80379 | TGTACCATGCCTGGCAGATG | 78 | n/a | n/a | soooosssssssssssooss | 601 |
| 613334 | 81325 | 81344 | GTTAGATGTATGTATGATGG | 0 | n/a | n/a | soooosssssssssssooss | 602 |
| 613412 | 73879 | 73898 | GTGATCTTCCATCACTTCGA | 80 | 345 | 364 | soooosssssssssssooss | 25 |

TABLE 15

Inhibition of Tau mRNA by 5-10-5 MOE gapmers with phosphorothioate and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 433475 | n/a | n/a | TCTTCAGCTTTCAGGCCAGC | 31 | 443 | 462 | sssssssssssssssssss | 96 |
| 613335 | 82136 | 82155 | GCCTCCTCCTAGAGCTCCTG | 81 | n/a | n/a | soooosssssssssssooss | 603 |
| 613336 | 83231 | 83250 | CGGCCTCGCAACAAACCCAC | 55 | n/a | n/a | soooosssssssssssooss | 604 |
| 613337 | 83820 | 83839 | TCCACTGACCTGCCCCTTCC | 66 | n/a | n/a | soooosssssssssssooss | 605 |
| 613338 | 84269 | 84288 | TTTGCAACTTGTTCCTGCTT | 84 | n/a | n/a | soooosssssssssssooss | 606 |
| 613339 | 85073 | 85092 | TCTTGGGTGCAGGCGGAGCA | 53 | n/a | n/a | soooosssssssssssooss | 607 |
| 613340 | 86117 | 86136 | ACCCAAGATTCCCAGGAGCC | 77 | n/a | n/a | soooosssssssssssooss | 608 |
| 613341 | 86191 | 86210 | AGGCCCTAAATGCTCTGAGA | 75 | n/a | n/a | soooosssssssssssooss | 609 |
| 613342 | 86251 | 86270 | AGAAGTCTCTGGAACTGACG | 70 | n/a | n/a | soooosssssssssssooss | 610 |
| 613343 | 86714 | 86733 | TCACCAAACCAATGGCTGGC | 67 | n/a | n/a | soooosssssssssssooss | 611 |
| 613344 | 86774 | 86793 | GGTGAAATCCTGGCTAGGCC | 89 | n/a | n/a | soooosssssssssssooss | 612 |
| 613345 | 88487 | 88506 | TGCAGATTCGGCCTGAGTTT | 72 | n/a | n/a | soooosssssssssssooss | 613 |
| 613346 | 89131 | 89150 | CCAAACAAGAAAGACTGAGA | 55 | n/a | n/a | soooosssssssssssooss | 614 |
| 613347 | 89994 | 90013 | CCATGTCCCTCCCCCCAACC | 12 | n/a | n/a | soooosssssssssssooss | 615 |
| 613348 | 90126 | 90145 | ATTAGAAAAAAACCACTAGG | 37 | n/a | n/a | soooosssssssssssooss | 616 |
| 613349 | 92246 | 92265 | AGCTTACTAGAGTGCTCTTG | 81 | n/a | n/a | soooosssssssssssooss | 617 |
| 613350 | 92915 | 92934 | ATTTTTTTCTGGTTCATTCA | 71 | n/a | n/a | soooosssssssssssooss | 618 |
| 613351 | 94316 | 94335 | CGCTTAAGAGAGGGAGCATC | 72 | n/a | n/a | soooosssssssssssooss | 619 |
| 613352 | 94673 | 94692 | GTGGAGATACGCAGTGGTGG | 68 | n/a | n/a | soooosssssssssssooss | 620 |
| 613353 | 95790 | 95809 | ACACCATGAGGGCACCCGTC | 82 | n/a | n/a | soooosssssssssssooss | 35 |
| 613354 | 95918 | 95937 | CCCAAACCTGGCTCTGTCAC | 65 | n/a | n/a | soooosssssssssssooss | 621 |
| 613355 | 97224 | 97243 | ATCAACCAGCACCATCCACG | 65 | n/a | n/a | soooosssssssssssooss | 622 |
| 613356 | 97314 | 97333 | GGGTCTGTAAGCCTAAAGTG | 53 | n/a | n/a | soooosssssssssssooss | 623 |
| 613357 | 97315 | 97334 | TGGGTCTGTAAGCCTAAAGT | 56 | n/a | n/a | soooosssssssssssooss | 624 |
| 613358 | 97368 | 97387 | TATACTATGTGGCAGAATCA | 48 | n/a | n/a | soooosssssssssssooss | 625 |
| 613359 | 97478 | 97497 | CACATTCCCTCTACCCCATG | 57 | n/a | n/a | soooosssssssssssooss | 626 |
| 613360 | 97507 | 97526 | TCATAGATTTTCTTCTTTGG | 75 | n/a | n/a | soooosssssssssssooss | 627 |
| 613361 | 98881 98918 | 98900 98937 | ACACACCTTCATTTACTGTC | 95 | n/a n/a | n/a n/a | soooosssssssssssooss soooossssssssssssooss | 313 |
| 613362 | 98882 98919 | 98901 98938 | AACACACCTTCATTTACTGT | 83 | n/a n/a | n/a n/a | soooosssssssssssooss soooossssssssssssooss | 314 |
| 613363 | 98883 98920 | 98902 98939 | AAACACACCTTCATTTACTG | 79 | n/a n/a | n/a n/a | soooosssssssssssooss soooossssssssssssooss | 315 |
| 613364 | 98884 98921 | 98903 98940 | CAAACACACCTTCATTTACT | 63 | n/a n/a | n/a n/a | soooosssssssssssooss soooossssssssssssooss | 316 |
| 613365 | 98885 98922 | 98904 98941 | TCAAACACACCTTCATTTAC | 59 | n/a n/a | n/a n/a | soooosssssssssssooss soooossssssssssssooss | 317 |
| 613366 | 98886 98923 | 98905 98942 | TTCAAACACACCTTCATTTA | 67 | n/a n/a | n/a n/a | soooosssssssssssooss soooossssssssssssooss | 628 |

TABLE 15-continued

Inhibition of Tau mRNA by 5-10-5 MOE gapmers with phosphorothioate
and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 613367 | 98887 | 98906 | TTTCAAACACACCTTCATTT | 72 | n/a | n/a | sooooosssssssssssooss | 318 |
|  | 98924 | 98943 |  |  | n/a | n/a | sooooosssssssssssooss |  |
| 613368 | 98888 | 98907 | TTTTCAAACACACCTTCATT | 59 | n/a | n/a | sooooosssssssssssooss | 319 |
|  | 98925 | 98944 |  |  | n/a | n/a | sooooosssssssssssooss |  |
| 613369 | 98889 | 98908 | GTTTTCAAACACACCTTCAT | 90 | n/a | n/a | sooooosssssssssssooss | 320 |
|  | 98926 | 98945 |  |  | n/a | n/a | sooooosssssssssssooss |  |
| 613370 | 98890 | 98909 | GGTTTTCAAACACACCTTCA | 96 | n/a | n/a | sooooosssssssssssooss | 321 |
|  | 98927 | 98946 |  |  | n/a | n/a | sooooosssssssssssooss |  |
| 613371 | 98891 | 98910 | TGGTTTTCAAACACACCTTC | 95 | n/a | n/a | sooooosssssssssssooss | 322 |
|  | 98928 | 98947 |  |  | n/a | n/a | sooooosssssssssssooss |  |
| 613372 | 99560 | 99579 | CCCCAGCTGGCCGAGGCCCA | 81 | n/a | n/a | sooooosssssssssssooss | 629 |
| 613373 | 99816 | 99835 | GAGAAGGGTCCTGTCCCAGA | 76 | n/a | n/a | sooooosssssssssssooss | 630 |
| 613374 | 100743 | 100762 | AGTAAGTTGATGGAGATCAT | 83 | n/a | n/a | sooooosssssssssssooss | 631 |
| 613375 | 102894 | 102913 | CACCAGCCCCACTCCGCCAC | 61 | n/a | n/a | sooooosssssssssssooss | 632 |
| 613376 | 103875 | 103894 | TGCTCTGTCTCCAGAGACAT | 70 | n/a | n/a | sooooosssssssssssooss | 633 |
| 613377 | 104615 | 104634 | ATCCAAGATCCAGGCCAGGC | 63 | n/a | n/a | sooooosssssssssssooss | 634 |
| 613378 | 105870 | 105889 | AGAGACCCAGGGTGACCAGT | 76 | n/a | n/a | sooooosssssssssssooss | 635 |
| 613379 | 106909 | 106928 | CAAATTTCTCGATCCCCTTC | 18 | n/a | n/a | sooooosssssssssssooss | 636 |
| 613380 | 108411 | 108430 | CCTGAGGAGGGCACTCACAG | 61 | n/a | n/a | sooooosssssssssssooss | 637 |
| 613381 | 108891 | 108910 | GTGGCTACCCACGGCCACAG | 1 | n/a | n/a | sooooosssssssssssooss | 638 |
| 613382 | 108939 | 108958 | CTACCAGGAGCACACACAGA | 65 | n/a | n/a | sooooosssssssssssooss | 639 |
| 613383 | 109303 | 109322 | CCCTAAGCCATGGTGGGTTT | 72 | n/a | n/a | sooooosssssssssssooss | 640 |
| 613384 | 109995 | 110014 | CCCTTGTCCCCACAGCCACA | 72 | n/a | n/a | sooooosssssssssssooss | 641 |
| 613385 | 110198 | 110217 | GGGTCACCTGTGAGTTATTT | 62 | n/a | n/a | sooooosssssssssssooss | 642 |
| 613386 | 113567 | 113586 | AGCTGCCTCCAGTTGTTTAT | 85 | n/a | n/a | sooooosssssssssssooss | 643 |
| 613387 | 114056 | 114075 | ACTTTAGCTCCATCTTCTCA | 49 | n/a | n/a | sooooosssssssssssooss | 644 |
| 613388 | 114755 | 114774 | CTATAATGGTCAGTGGTGTA | 67 | n/a | n/a | sooooosssssssssssooss | 645 |
| 613389 | 115899 | 115918 | TGAAGGAGAGGCTGTGGTGA | 41 | n/a | n/a | sooooosssssssssssooss | 646 |
| 613390 | 117387 | 117406 | TGTGACAACAAAGTTGTCCT | 46 | n/a | n/a | sooooosssssssssssooss | 647 |
| 613391 | 117654 | 117673 | CCCTGCAATCAACACAGGAG | 65 | n/a | n/a | sooooosssssssssssooss | 648 |
| 613392 | 119050 | 119069 | TCTAACATGCACATATTTAC | 60 | n/a | n/a | sooooosssssssssssooss | 649 |
| 613393 | 119190 | 119209 | AGCACTGGGTGTTTACAACA | 84 | n/a | n/a | sooooosssssssssssooss | 650 |
| 613394 | 119594 | 119613 | AGAAGTGATATCATATCCTA | 85 | n/a | n/a | sooooosssssssssssooss | 324 |
|  | 119905 | 119924 |  |  | n/a | n/a | sooooosssssssssssooss |  |
| 613395 | 119595 | 119614 | AAGAAGTGATATCATATCCT | 68 | n/a | n/a | sooooosssssssssssooss | 325 |
|  | 119906 | 119925 |  |  | n/a | n/a | sooooosssssssssssooss |  |
| 613396 | 120782 | 120801 | ACCCGGTGACCTTTCCTCTC | 67 | n/a | n/a | sooooosssssssssssooss | 651 |
| 613397 | 121728 | 121747 | GAGTGACATGCGCCACCCTG | 87 | n/a | n/a | sooooosssssssssssooss | 203 |
| 613398 | 121794 | 121813 | AAAAGGATGAGTGACACGCC | 66 | n/a | n/a | sooooosssssssssssooss | 205 |

TABLE 15-continued

Inhibition of Tau mRNA by 5-10-5 MOE gapmers with phosphorothioate and phosphodiester internucleoside linkages targeting SEQ ID NOs: 1 and 3

| ISIS NO | SEQ ID NO: 1 Start Site | SEQ ID NO: 1 Stop Site | Sequence | % inhibition | SEQ ID NO: 3 Start Site | SEQ ID NO: 3 Stop Site | Linkage chemistry | SEQ ID NO |
|---|---|---|---|---|---|---|---|---|
| 613399 | 121940 | 121959 | GCCACAGCACGGCGCATGGG | 89 | n/a | n/a | soooosssssssssssooss | 652 |
| 613400 | 124954 | 124973 | GCACCGCTCCCTCTGGGAAT | 49 | n/a | n/a | soooosssssssssssooss | 653 |
| 613401 | 125298 | 125317 | AAATCTTGCTGGAAAGGCAG | 64 | n/a | n/a | soooosssssssssssooss | 654 |
| 613402 | 125428 | 125447 | GACCCAGACATTTGCTCAGC | 86 | n/a | n/a | soooosssssssssssooss | 655 |
| 613403 | 125982 | 126001 | GGGCTCCCGCAAGTTTCACA | 71 | n/a | n/a | soooosssssssssssooss | 656 |
| 613404 | 127460 | 127479 | GAGAGGCCCTGTGGACAGCT | 75 | n/a | n/a | soooosssssssssssooss | 657 |
| 613405 | 130381 | 130400 | CCCACTGGATGCTGCTGAGG | 34 | n/a | n/a | soooosssssssssssooss | 658 |
| 613406 | 131662 | 131681 | GTGCCTAGTAACCCATTTAG | 54 | n/a | n/a | soooosssssssssssooss | 659 |
| 613407 | 131796 | 131815 | CACCCACAGCAAGACCTAGA | 49 | n/a | n/a | soooosssssssssssooss | 660 |
| 613408 | 133056 | 133075 | ACACAGAGAAGCTTCCAGAG | 70 | n/a | n/a | soooosssssssssssooss | 661 |
| 613409 | 133304 | 133323 | AGCTATCACATGGACGAGTT | 67 | n/a | n/a | soooosssssssssssooss | 662 |
| 613410 | 133548 | 133567 | CATTTAATACAGGCTTTGAT | 38 | n/a | n/a | soooosssssssssssooss | 663 |
| 613411 | 134599 | 134618 | AGCCACTGATGCCCAGACAT | 69 | n/a | n/a | soooosssssssssssooss | 664 |
| 613412 | 73879 | 73898 | GTGATCTTCCATCACTTCGA | 82 | 345 | 364 | soooosssssssssssooss | 25 |

TABLE 16

Inhibition of Tau mRNA by 5-10-5 MOE gapmers with phosphorothioate and phosphodiester internucleoside linkages targeting SEQ ID NOs: 5 and 6

| ISIS NO | Target SEQ ID NO | Target Start Site | Sequence | % inhibition | Linkage chemistry | SEQ ID NO |
|---|---|---|---|---|---|---|
| 613239 | 5 | 3 | TGCCCTTCGCGGTCCCTTCG | 11 | soooosssssssssssooss | 396 |
| 613241 | 5 | 424 | CTGTCCCCCAAACCCGTACG | 48 | soooosssssssssssooss | 397 |
| 613248 | 6 | 524 | GCTTCCGCTGTTGGAGTGCT | 59 | soooosssssssssssooss | 398 |

Example 8

Dose-Dependent Antisense Inhibition of Human Tau in SH-SY5Y Cells by 5-10-5 MOE Gapmers with Phosphorothioate and Phosphodiester Internucleoside Linkages Gapmers from studies described above exhibiting significant in vitro inhibition of tau mRNA were selected and tested at various doses in SH-SY-5Y cells. Cells were plated at a density of 20,000 cells per well and transfected using electroporation with 1.25 μM, 2.500 μM, 5.00 μM, 10.00 μM, and 20.00 μM concentrations of antisense oligonucleotide, as specified in the Table below. After a treatment period of approximately 16 hours, RNA was isolated from the cells and Tau mRNA levels were measured by quantitative real-time PCR. Human primer probe set RTS3104 was used to measure mRNA levels. Tau mRNA levels were adjusted according to total RNA content, as measured by RIBOGREEN®. Results are presented as percent inhibition of Tau, relative to untreated control cells. Tau mRNA levels were significantly reduced in a dose-dependent manner in antisense oligonucleotide treated cells.

TABLE 17

| ISIS No | 1.25 μM | 2.50 μM | 5.00 μM | 10.00 μM | 20.00 μM |
|---|---|---|---|---|---|
| 613118 | 46 | 47 | 73 | 92 | 93 |
| 613136 | 36 | 70 | 83 | 88 | 92 |
| 613115 | 32 | 49 | 82 | 86 | 94 |
| 613329 | 73 | 80 | 92 | 94 | 92 |
| 613273 | 46 | 24 | 48 | 60 | 85 |
| 613262 | 31 | 72 | 76 | 87 | 94 |
| 613271 | 44 | 66 | 84 | 89 | 94 |
| 613370 | 92 | 92 | 95 | 98 | 98 |

TABLE 17-continued

| ISIS No | 1.25 μM | 2.50 μM | 5.00 μM | 10.00 μM | 20.00 μM |
|---|---|---|---|---|---|
| 613361 | 88 | 86 | 89 | 94 | 96 |
| 613371 | 80 | 88 | 91 | 95 | 97 |
| 613369 | 58 | 85 | 89 | 95 | 96 |
| 613399 | 61 | 77 | 90 | 94 | 96 |
| 613344 | 80 | 79 | 93 | 95 | 95 |
| 613397 | 64 | 74 | 79 | 93 | 95 |
| 613412 | 45 | 66 | 70 | 81 | 96 |

TABLE 18

| ISIS No | 1.25 μM | 2.50 μM | 5.00 μM | 10.00 μM | 20.00 μM |
|---|---|---|---|---|---|
| 613255 | 54 | 61 | 80 | 91 | 90 |
| 613065 | 22 | 61 | 62 | 83 | 89 |
| 613257 | 45 | 69 | 82 | 86 | 91 |
| 613098 | 70 | 57 | 83 | 92 | 98 |
| 613253 | 44 | 67 | 74 | 86 | 91 |
| 613039 | 21 | 77 | 85 | 90 | 95 |
| 613188 | 0 | 35 | 72 | 86 | 87 |
| 613042 | 33 | 45 | 73 | 90 | 94 |
| 613233 | 21 | 54 | 69 | 75 | 89 |
| 613073 | 59 | 67 | 83 | 92 | 97 |
| 613187 | 8 | 54 | 74 | 61 | 84 |
| 613402 | 10 | 58 | 62 | 81 | 87 |
| 613045 | 57 | 72 | 92 | 96 | 95 |
| 613412 | 20 | 52 | 67 | 84 | 90 |
| 613099 | 71 | 66 | 89 | 91 | 95 |

Example 9

Antisense Inhibition of Human Tau in SH-SY5Y Cells by 5-10-5 MOE, 5-8-5 MOE, 4-8-6 MOE, or 6-8-4 MOE Gapmers Antisense oligonucleotides were designed targeting a tau nucleic acid and were tested for their effects on Tau mRNA in vitro. The antisense oligonucleotides were tested in a series of experiments that had similar culture conditions. ISIS 613412 was also included in the assays. The results for each experiment are presented in separate tables shown below. Cultured SH-SY5Y cells at a density of 20,000 cells per well were transfected using electroporation with 8,000 nM antisense oligonucleotide. After a treatment period of approximately 24 hours, RNA was isolated from the cells and Tau mRNA levels were measured by quantitative real-time PCR. Human primer probe set RTS3104 was used to measure mRNA levels. Tau mRNA levels were adjusted according to total RNA content, as measured by RIBOGREEN®. Results are presented as percent inhibition of tau, relative to untreated control cells.

The newly designed chimeric antisense oligonucleotides in the Tables below were designed as 5-8-5 MOE, 4-8-6 MOE, or 6-8-4 MOE gapmers. The 5-8-5 MOE gapmers are 18 nucleosides in length, wherein the central gap segment comprises of eight 2'-deoxynucleosides and is flanked by wing segments on the 5' direction and the 3' direction comprising five nucleosides each. The 4-8-6 MOE gapmers are 18 nucleosides in length, wherein the central gap segment comprises of eight 2'-deoxynucleosides and is flanked by wing segments on the 5' direction and the 3' direction comprising four and six nucleosides respectively. The 6-8-4 MOE gapmers are 18 nucleosides in length, wherein the central gap segment comprises of eight 2'-deoxynucleosides and is flanked by wing segments on the 5' direction and the 3' direction comprising six and four nucleosides respectively. Each nucleoside in the 5' wing segment and each nucleoside in the 3' wing segment has a 2'-MOE modification. The internucleoside linkage motif throughout for each gapmer in the tables below, except for ISIS 613412, is 5'-sooosssssssssooss-3', wherein each "s" represents a phosphorothioate internucleoside linkage and wherein each "o" represents a phosphodiester internucleoside linkage. The internucleoside linkage motif for ISIS 613412 is 5'-soooosssssssssooss-3', wherein each "s" represents a phosphorothioate internucleoside linkage and wherein each "o" represents a phosphodiester internucleoside linkage. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either SEQ ID NO: 1 (GENBANK Accession No. NT_010783.15 truncated from nucleotides 9240000 to 9381000), SEQ ID NO: 4 (GENBANK Accession No. NT_010783.14 truncated from nucleotides 2624000 to 2761000), SEQ ID NO: 5 (GENBANK Accession No. DR002467.1), or SEQ ID NO: 6 (GENBANK Accession No. NM_001203251.1). 'n/a.' indicates that the antisense oligonucleotide does not target that particular gene sequence with 100% complementarity.

TABLE 19

Inhibition of tau mRNA by 5-10-5 MOE and 5-8-5 MOE gapmers targeting SEQ ID NO: 1 and SEQ ID NO: 4

| ISIS NO | SEQ ID NO: 1 Start Site | SEQ ID NO: 1 Stop Site | Sequence | % inhibition | SEQ ID NO: 4 Start Site | SEQ ID NO: 4 Stop Site | Motif | SEQ ID NO |
|---|---|---|---|---|---|---|---|---|
| 613412 | 73879 | 73898 | GTGATCTTCCATCACTTCGA | 83 | 69842 | 69861 | 5-10-5 | 25 |
| 620887 | 98891 98928 | 98908 98945 | GTTTTCAAACACACCTTC | 89 | 94855 94892 | 94872 94909 | 5-8-5 | 665 |
| 621197 | n/a | n/a | TCGCCAACAGACATGTGA | 39 | 64850 | 64867 | 5-8-5 | 666 |
| 621196 | 67898 | 67915 | TGAAGGAGCCTGGGAAGT | 15 | 63891 | 63908 | 5-8-5 | 667 |
| 621198 | 69079 | 69096 | AGCAGAGATGTGGCTGGG | 50 | 65044 | 65061 | 5-8-5 | 668 |
| 621199 | 69622 | 69639 | GTGAGGTTGAAAAGTTTC | 34 | 65587 | 65604 | 5-8-5 | 669 |

TABLE 19-continued

Inhibition of tau mRNA by 5-10-5 MOE and 5-8-5 MOE gapmers targeting SEQ ID NO: 1 and SEQ ID NO: 4

| ISIS NO | SEQ ID NO: 1 Start Site | SEQ ID NO: 1 Stop Site | Sequence | % inhibition | SEQ ID NO: 4 Start Site | SEQ ID NO: 4 Stop Site | Motif | SEQ ID NO |
|---|---|---|---|---|---|---|---|---|
| 621200 | 69802 | 69819 | TGGTTTCTGATGGTTTTT | 43 | 65767 | 65784 | 5-8-5 | 670 |
| 621201 | 70023 | 70040 | GTTGGAACTCCTGGGATC | 27 | 65988 | 66005 | 5-8-5 | 671 |
| 621202 | 70259 | 70276 | TCAGCATTTTTCTCCTCT | 47 | 66224 | 66241 | 5-8-5 | 672 |
| 621203 | 70531 | 70548 | CTGGAATGGTACGATCTC | 52 | 66496 | 66513 | 5-8-5 | 673 |
| 621204 | 70750 | 70767 | CCACTCTGGTGCAGGACG | 29 | 66715 | 66732 | 5-8-5 | 674 |
| 621205 | 70930 | 70947 | CAGATGCAGTGCAAGTGG | 43 | 66895 | 66912 | 5-8-5 | 675 |
| 621206 | 71110 | 71127 | GGGTTTCACCAGACCTCA | 29 | 67075 | 67092 | 5-8-5 | 676 |
| 621207 | 71306 | 71323 | CTTTGTCCATAATTTTTT | 34 | 67271 | 67288 | 5-8-5 | 677 |
| 621208 | 71487 | 71504 | TATAGCATGAGCATTTGT | 42 | 67452 | 67469 | 5-8-5 | 678 |
| 621209 | 71667 | 71684 | TAATGAATGTATAACAGA | 2 | 67632 | 67649 | 5-8-5 | 679 |
| 621210 | 71850 | 71867 | TCCTCCTGGCTGCCCTGT | 33 | 67815 | 67832 | 5-8-5 | 680 |
| 621211 | 72030 | 72047 | CATCCTGCCATACCAGAC | 32 | 67995 | 68012 | 5-8-5 | 681 |
| 621212 | 72224 | 72241 | TATCCGCCTCTCAAAGTG | 0 | 68189 | 68206 | 5-8-5 | 682 |
| 621213 | 72410 | 72427 | CACATTTGCATATTTTCA | 65 | 68373 | 68390 | 5-8-5 | 683 |
| 621214 | 72590 | 72607 | TCGGGTTGCCCCATTCAA | 27 | 68553 | 68570 | 5-8-5 | 684 |
| 621215 | 72770 | 72787 | AACCACCATTTACTCACA | 35 | 68733 | 68750 | 5-8-5 | 685 |
| 621216 | 72950 | 72967 | ACCGGCACCCACCAGGTC | 22 | 68913 | 68930 | 5-8-5 | 686 |
| 621217 | 73130 | 73147 | AGGGACAGCATCAGCAGA | 22 | 69093 | 69110 | 5-8-5 | 687 |
| 621218 | 73437 | 73454 | AGGCATGTGGCAGGTGCC | 12 | 69400 | 69417 | 5-8-5 | 688 |
| 621219 | 73617 | 73634 | ACCAACACCGCAGCAGTT | 35 | 69580 | 69597 | 5-8-5 | 689 |
| 621220 | 73797 | 73814 | GTTCTGAGGAGTGTTGGG | 0 | 69760 | 69777 | 5-8-5 | 690 |
| 621221 | 73978 | 73995 | ACTAACCTTTCAGGCCAG | 33 | 69941 | 69958 | 5-8-5 | 691 |
| 621222 | 74273 | 74290 | TAAATTATTTTAGAGACG | 0 | 70236 | 70253 | 5-8-5 | 692 |
| 621223 | 74467 | 74484 | CAAGGTAAATTTCTTTCT | 69 | 70430 | 70447 | 5-8-5 | 693 |
| 621224 | 74647 | 74664 | TCAGGCCTGATCTAAGTA | 14 | 70610 | 70627 | 5-8-5 | 694 |
| 621225 | 74827 | 74844 | TCCCCAACCATGTGGTCT | 40 | 70790 | 70807 | 5-8-5 | 695 |
| 621226 | 75007 | 75024 | TGCCAGCCACACCCATGG | 52 | 70970 | 70987 | 5-8-5 | 696 |
| 621227 | 75187 | 75204 | AACTCCACGGCTTCCATG | 50 | 71150 | 71167 | 5-8-5 | 697 |
| 621228 | 75371 | 75388 | AGATAGAAATCTGAAACG | 34 | 71334 | 71351 | 5-8-5 | 698 |
| 621229 | 75551 | 75568 | GCTGGGCCGAGCTGCATT | 66 | 71514 | 71531 | 5-8-5 | 699 |
| 621230 | 75891 | 75908 | GGATTCAAAGGAGAAAAC | 35 | 71854 | 71871 | 5-8-5 | 700 |
| 621231 | 76192 | 76209 | ATTATTATTTGACATGGG | 75 | 72155 | 72172 | 5-8-5 | 701 |
| 621232 | 76373 | 76390 | AGGGTAGGCAGTGTTGTG | 4 | 72336 | 72353 | 5-8-5 | 702 |
| 621233 | 76553 | 76570 | CTCTCTTTGTCAGGAAAA | 58 | 72516 | 72533 | 5-8-5 | 703 |
| 621234 | 76942 | 76959 | CCTTTTTTTTTAGGACGG | 0 | 72905 | 72922 | 5-8-5 | 704 |
| 621235 | 77222 | 77239 | GAGTTGACTGGGCACGGT | 33 | 73185 | 73202 | 5-8-5 | 705 |

TABLE 19-continued

Inhibition of tau mRNA by 5-10-5 MOE and 5-8-5 MOE gapmers targeting SEQ ID NO: 1 and SEQ ID NO: 4

| ISIS NO | SEQ ID NO: 1 Start Site | SEQ ID NO: 1 Stop Site | Sequence | % inhibition | SEQ ID NO: 4 Start Site | SEQ ID NO: 4 Stop Site | Motif | SEQ ID NO |
|---|---|---|---|---|---|---|---|---|
| 621236 | 77414 | 77431 | TCATCTGTGAAGCGGACG | 81 | 73377 | 73394 | 5-8-5 | 706 |
| 621237 | 77594 | 77611 | GGCACAATCCATATGAGG | 56 | 73557 | 73574 | 5-8-5 | 707 |
| 621238 | 77781 | 77798 | GTTATTTTGGAACAGTTT | 87 | 73744 | 73761 | 5-8-5 | 708 |
| 621239 | 78117 | 78134 | CTGGACTTTATTTCATTT | 77 | 74080 | 74097 | 5-8-5 | 709 |
| 621240 | 78319 | 78336 | CAGTATATATAGTGCATA | 76 | 74282 | 74299 | 5-8-5 | 710 |
| 621241 | 78499 | 78516 | CAAAACAGCTCCTTGTAA | 14 | 74462 | 74479 | 5-8-5 | 711 |
| 621242 | 78679 | 78696 | ACTTTCATCTACTTTTCA | 32 | 74642 | 74659 | 5-8-5 | 712 |
| 621243 | 78859 | 78876 | CCAATCTGTCCCCAGCTT | 42 | 74822 | 74839 | 5-8-5 | 713 |
| 621244 | 79039 | 79056 | TCCAGCATGAACATAGCT | 65 | 75002 | 75019 | 5-8-5 | 714 |
| 621245 | 79219 | 79236 | TAGAGTCAGTTTCAGGAT | 75 | 75182 | 75199 | 5-8-5 | 715 |
| 621246 | 79399 | 79416 | GGTGGTATCACCAACAGC | 35 | 75362 | 75379 | 5-8-5 | 716 |
| 621247 | 79589 | 79606 | TTAAGGAATGGCTCTGGG | 42 | 75552 | 75569 | 5-8-5 | 717 |
| 621248 | 79769 | 79786 | GAACATGAGACATCTTGA | 8 | 75732 | 75749 | 5-8-5 | 718 |
| 621249 | 79949 | 79966 | AGCTGTGCCCAGTTAAAA | 53 | 75912 | 75929 | 5-8-5 | 719 |
| 621250 | 80129 | 80146 | TCTGGTCATATGAGGAAA | 55 | 76092 | 76109 | 5-8-5 | 720 |
| 621251 | 80309 | 80326 | AGTCATTATCATGTCACC | 89 | 76272 | 76289 | 5-8-5 | 721 |
| 621252 | 80489 | 80506 | GCTGAGCGAATTACCTAA | 75 | 76452 | 76469 | 5-8-5 | 722 |
| 621253 | 80669 | 80686 | CCTCTGTATGACAGAAAT | 48 | 76632 | 76649 | 5-8-5 | 723 |
| 621254 | 80849 | 80866 | GGTAACATGTAAAGCTTC | 79 | 76812 | 76829 | 5-8-5 | 724 |
| 621255 | 81033 81136 | 81050 81153 | TGGATTATGTACAGATAT | 28 | 76996 77099 | 77013 77116 | 5-8-5 | 725 |
| 621256 | 81110 81213 | 81127 81230 | ATGGATGATAGGAAGGAT | 20 | 77073 77176 | 77090 77193 | 5-8-5 | 726 |
| 621257 | 81393 | 81410 | GATGGAGGAAGGAATGAT | 5 | 77356 | 77373 | 5-8-5 | 727 |
| 621258 | 81629 | 81646 | CTGGATGGTTACATGGAT | 31 | 77592 | 77609 | 5-8-5 | 728 |
| 621259 | 81812 | 81829 | ATAATTGATGTATAATTA | 0 | 77775 | 77792 | 5-8-5 | 729 |
| 621260 | 81992 | 82009 | GTTCTGCCCCACCTGGGC | 56 | 77955 | 77972 | 5-8-5 | 730 |
| 621261 | 82198 | 82215 | GCCTCTCAGGGCCTCCGT | 76 | 78161 | 78178 | 5-8-5 | 731 |
| 621262 | 82378 | 82395 | GAAGGATGGCCACACAGA | 39 | 78341 | 78358 | 5-8-5 | 732 |
| 621263 | 82558 | 82575 | ATGGGCTTATCAATGCAT | 85 | 78521 | 78538 | 5-8-5 | 733 |
| 621264 | 82738 | 82755 | GAGGCCCAAATGATCACA | 56 | 78701 | 78718 | 5-8-5 | 734 |
| 621265 | 82918 | 82935 | GCTCAGGGCAGACACGGT | 66 | 78881 | 78898 | 5-8-5 | 735 |
| 621266 | 83098 | 83115 | CTTAACCAGCTAGTGGTG | 38 | 79061 | 79078 | 5-8-5 | 736 |
| 621267 | 83278 | 83295 | GTCCTGTGGAGCTGAAAA | 54 | 79241 | 79258 | 5-8-5 | 737 |
| 621268 | 83486 | 83503 | GGCTGGAGGCATGGAGGG | 7 | 79449 | 79466 | 5-8-5 | 738 |
| 621269 | 83666 | 83683 | TGCCTCCAGAGCACACAC | 55 | 79629 | 79646 | 5-8-5 | 739 |

TABLE 19-continued

Inhibition of tau mRNA by 5-10-5 MOE and 5-8-5 MOE gapmers targeting SEQ ID NO: 1 and SEQ ID NO: 4

| ISIS NO | SEQ ID NO: 1 Start Site | SEQ ID NO: 1 Stop Site | Sequence | % inhibition | SEQ ID NO: 4 Start Site | SEQ ID NO: 4 Stop Site | Motif | SEQ ID NO |
|---|---|---|---|---|---|---|---|---|
| 621270 | 83846 | 83863 | AGGATACTAAACCAAGAT | 24 | 79809 | 79826 | 5-8-5 | 740 |
| 621271 | 84026 | 84043 | CACAGATGGGAAGCAAGA | 20 | 79989 | 80006 | 5-8-5 | 741 |
| 621272 | 84206 | 84223 | CATGAGGCAACAATCCAA | 70 | 80169 | 80186 | 5-8-5 | 742 |

TABLE 20

Inhibition of tau mRNA by 5-10-5 MOE and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 613412 | 73879 | 73898 | GTGATCTTCCATCACTTCGA | 80 | 5-10-5 | 25 |
| 620887 | 98891 98928 | 98908 98945 | GTTTTCAAACACACCTTC | 92 | 5-8-5 | 665 |
| 621273 | 84386 | 84403 | GCCGTAAGACCCAGCTCT | 58 | 5-8-5 | 743 |
| 621274 | 84566 | 84583 | GAAGAAGTACTGAGAAAG | 14 | 5-8-5 | 744 |
| 621275 | 84746 | 84763 | TAAGAACCTCAGCGGCAA | 56 | 5-8-5 | 745 |
| 621276 | 84926 | 84943 | TGAGGGAGCACTGAGAGT | 21 | 5-8-5 | 746 |
| 621277 | 85106 | 85123 | AGTTCAATGAAGGACATT | 69 | 5-8-5 | 747 |
| 621278 | 85287 | 85304 | ACTGTTGGATGGGTCCAC | 70 | 5-8-5 | 748 |
| 621279 | 85467 | 85484 | TTGGTCCATTTTGATTGG | 0 | 5-8-5 | 749 |
| 621280 | 85647 | 85664 | CGGCAGCCCTGTGTAAAC | 48 | 5-8-5 | 750 |
| 621281 | 85828 | 85845 | CCTTTGCTTCTTGCGCAG | 66 | 5-8-5 | 751 |
| 621282 | 86014 | 86031 | AGGGCCTTGACTGCCTGG | 15 | 5-8-5 | 752 |
| 621283 | 86194 | 86211 | AAGGCCCTAAATGCTCTG | 57 | 5-8-5 | 753 |
| 621284 | 86384 | 86401 | CGCTCAGGTGATCTTGGG | 76 | 5-8-5 | 754 |
| 621285 | 86564 | 86581 | CTGATTGATTCCCCATCA | 64 | 5-8-5 | 755 |
| 621286 | 86746 | 86763 | TTCTTGTTGGGCAACTGG | 59 | 5-8-5 | 756 |
| 621287 | 86928 | 86945 | GAAATGCACTCAGAAGGG | 52 | 5-8-5 | 757 |
| 621288 | 87108 | 87125 | CCTCAGTGAAATAACTGT | 55 | 5-8-5 | 758 |
| 621289 | 87288 | 87305 | TGGCTGCAACTTTGAATG | 0 | 5-8-5 | 759 |
| 621290 | 87470 | 87487 | CTGGAGATGGCAGGCTGG | 39 | 5-8-5 | 760 |
| 621291 | 87653 | 87670 | CCCGTGGGCCCCATGTGG | 1 | 5-8-5 | 761 |
| 621292 | 87834 | 87851 | ATTGAGGACACCTGGTGT | 6 | 5-8-5 | 762 |
| 621293 | 88014 | 88031 | AAGGTCTGCATTGTCAGT | 61 | 5-8-5 | 763 |
| 621294 | 88194 | 88211 | CTGCTGGCCTCTCTGTAC | 56 | 5-8-5 | 764 |
| 621295 | 88374 | 88391 | TCGGACACGGTCACTGCC | 60 | 5-8-5 | 765 |

TABLE 20-continued

Inhibition of tau mRNA by 5-10-5 MOE and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 621296 | 88554 | 88571 | GTGCCTTGTCATGTGACA | 79 | 5-8-5 | 766 |
| 621297 | 88734 | 88751 | GGAAGCCATGTGGTAGCC | 50 | 5-8-5 | 767 |
| 621298 | 88918 | 88935 | CAGAGGCCACTGCCTCTG | 0 | 5-8-5 | 768 |
| 621299 | 89098 | 89115 | TTAATAGTACCAAAATCA | 25 | 5-8-5 | 769 |
| 621300 | 89278 | 89295 | TACATTTCCTTCCTCCCA | 10 | 5-8-5 | 770 |
| 621301 | 89470 | 89487 | CGGAGTCAGGCAGATGGG | 43 | 5-8-5 | 771 |
| 621302 | 89650 | 89667 | GCTATGACCTAGTAGGAA | 84 | 5-8-5 | 772 |
| 621303 | 89830 | 89847 | ATTGTTTACTAGAAACCA | 39 | 5-8-5 | 773 |
| 621304 | 90010 | 90027 | GGGCAGAGCCCACCCCAT | 40 | 5-8-5 | 774 |
| 621305 | 90190 | 90207 | AGGCTGGACAAGGCTAGC | 63 | 5-8-5 | 775 |
| 621306 | 90531 | 90548 | CATATTTGAGTTTCTTTT | 62 | 5-8-5 | 776 |
| 621307 | 90711 | 90728 | AATGATTACACAAAGCTG | 61 | 5-8-5 | 777 |
| 621308 | 90891 | 90908 | GAACAGTGTCTTTCCAGC | 73 | 5-8-5 | 778 |
| 621309 | 91071 | 91088 | ATGTGCCTTTCTGTGCCA | 89 | 5-8-5 | 779 |
| 621310 | 91251 | 91268 | AATGATTTCTAGAGGTCA | 54 | 5-8-5 | 780 |
| 621311 | 91431 | 91448 | CCATGATTCCAGGCTGCT | 80 | 5-8-5 | 781 |
| 621312 | 91816 | 91833 | CAGCCAGGCTAGTCTTGC | 80 | 5-8-5 | 782 |
| 621313 | 92037 | 92054 | AGGAGAATGTTCTTTTTT | 53 | 5-8-5 | 783 |
| 621314 | 92219 | 92236 | TTACTGTACTCTGATATA | 41 | 5-8-5 | 784 |
| 621315 | 92399 | 92416 | CCTTATGGGAGCCCTTTG | 54 | 5-8-5 | 785 |
| 621316 | 92579 | 92596 | CAGAGCGCAGCAGCACCT | 64 | 5-8-5 | 786 |
| 621317 | 92759 | 92776 | CTCACCAGCTCTGCTTTA | 53 | 5-8-5 | 787 |
| 621318 | 92939 | 92956 | CAGCTGATCAAGGGCACA | 84 | 5-8-5 | 788 |
| 621319 | 93123 | 93140 | AGACCTGCCATAAGACTC | 39 | 5-8-5 | 789 |
| 621320 | 93380 | 93397 | CTGACTAAAATGTTATTT | 34 | 5-8-5 | 790 |
| 621321 | 93570 | 93587 | ACAGGCATGAGTTTTTTT | 61 | 5-8-5 | 791 |
| 621322 | 93840 | 93857 | CCCCTTTTTTTTGGTTTG | 2 | 5-8-5 | 792 |
| 621323 | 94020 | 94037 | TCTGGAGCCGCCCTGGGC | 36 | 5-8-5 | 793 |
| 621324 | 94200 | 94217 | ATGACAGCTCTCCTGGTC | 38 | 5-8-5 | 794 |
| 621325 | 94380 | 94397 | ACTCTCAACTCCTCTGGT | 49 | 5-8-5 | 795 |
| 621326 | 94576 | 94593 | TCCTGTTGGAGGAGGCGC | 7 | 5-8-5 | 796 |
| 621327 | 95433 | 95450 | CCTTTGAGTTGAGGGACC | 60 | 5-8-5 | 797 |
| 621328 | 95613 | 95630 | GCCTGAGCACGGGAGGAG | 41 | 5-8-5 | 798 |
| 621329 | 95793 | 95810 | GACACCATGAGGGCACCC | 69 | 5-8-5 | 799 |
| 621330 | 95986 | 96003 | AGCACCTCCTGGGAGGCG | 18 | 5-8-5 | 800 |
| 621331 | 96166 | 96183 | GGTGGCATGTGGACCAGG | 50 | 5-8-5 | 801 |

TABLE 20-continued

Inhibition of tau mRNA by 5-10-5 MOE and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 621332 | 96346 | 96363 | TGTGGCTCTGAGGTCTCC | 72 | 5-8-5 | 802 |
| 621333 | 96526 | 96543 | GCCTCTGTCTTAACTTTT | 50 | 5-8-5 | 803 |
| 621334 | 96778 | 96795 | TTAGGGTACAGTGGTGTG | 18 | 5-8-5 | 804 |
| 621335 | 96958 | 96975 | CCTCTAGTAGGCCAGTAT | 62 | 5-8-5 | 805 |
| 621336 | 97141 | 97158 | AATCAAGTAAGTTTGGGA | 57 | 5-8-5 | 806 |
| 621337 | 97321 | 97338 | CAACTGGGTCTGTAAGCC | 47 | 5-8-5 | 807 |
| 621338 | 97506 | 97523 | TAGATTTTCTTCTTTGGT | 45 | 5-8-5 | 808 |
| 621339 | 97686 | 97703 | GGGCACGAATTCTCACTG | 53 | 5-8-5 | 809 |
| 621340 | 97866 | 97883 | TCCAGAATAGGAGAGGCT | 9 | 5-8-5 | 810 |
| 621341 | 98046 | 98063 | ACACTGCAGCCAGGCTTG | 63 | 5-8-5 | 811 |
| 621342 | 98226 | 98243 | TGCAGTCTCCCTAACCCA | 59 | 5-8-5 | 812 |
| 621343 | 98406 | 98423 | CTCTTTTCCCTTGAATCT | 33 | 5-8-5 | 813 |
| 621344 | 98607 | 98624 | GTCAGCTTACCTTGGCTT | 44 | 5-8-5 | 814 |
| 621345 | 98802 | 98819 | CAACTGCTCTTCCCTGGG | 68 | 5-8-5 | 815 |
| 621346 | 98982 | 98999 | TCTGGGTGCAGTTTATGC | 80 | 5-8-5 | 816 |
| 621347 | 99162 | 99179 | AGAATTTATGCTGGAAAT | 38 | 5-8-5 | 817 |
| 621348 | 99342 | 99359 | GGCCAGCTCTCCAAATCC | 56 | 5-8-5 | 818 |
| 621349 | 99522 | 99539 | CCCTAGACTCTGGGCAAC | 66 | 5-8-5 | 819 |

TABLE 21

Inhibition of Tau mRNA by 5-10-5 MOE and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 613412 | 73879 | 73898 | GTGATCTTCCATCACTTCGA | 91 | 5-10-5 | 25 |
| 620887 | 98891 98928 | 98908 98945 | GTTTTCAAACACACCTTC | 96 | 5-8-5 | 665 |
| 620965 | 20187 | 20204 | TCTAAGTAATTCGATATG | 27 | 5-8-5 | 820 |
| 620966 | 20375 | 20392 | AAACAGAAACTAGGGTGG | 63 | 5-8-5 | 821 |
| 620967 | 20571 | 20588 | TCCCGCTGGGATCCATGG | 40 | 5-8-5 | 822 |
| 620968 | 20751 | 20768 | TGTTGCCATTGGGCAGCC | 0 | 5-8-5 | 823 |
| 620969 | 20931 | 20948 | GACCTTCTAATTAGTCCA | 58 | 5-8-5 | 824 |
| 620970 | 21291 | 21308 | GCGATTCTCTCCTGTCTC | 53 | 5-8-5 | 825 |
| 620971 | 21567 | 21584 | ACTCAGATTATTATTTTT | 87 | 5-8-5 | 826 |
| 620972 | 21747 | 21764 | AAAGTACTATCCACTTGT | 77 | 5-8-5 | 827 |

TABLE 21-continued

Inhibition of Tau mRNA by 5-10-5 MOE and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 620973 | 21927 | 21944 | CAAATCCTGGGTTCGAAT | 39 | 5-8-5 | 828 |
| 620974 | 22107 | 22124 | AGGTCTCTGCCCATGAAA | 59 | 5-8-5 | 829 |
| 620975 | 22287 | 22304 | AGATTTCTCCCTTCACCC | 46 | 5-8-5 | 830 |
| 620976 | 22467 | 22484 | TTAACATGATGGTGGTTT | 86 | 5-8-5 | 831 |
| 620977 | 22652 | 22669 | CATTGTGGAAATTAAACA | 50 | 5-8-5 | 832 |
| 620978 | 22837 | 22854 | TGTAGTCAATATTGAACT | 86 | 5-8-5 | 833 |
| 620979 | 23269 | 23286 | TTTTGAGAGCAGGTCTCG | 61 | 5-8-5 | 834 |
| 620980 | 23449 | 23466 | ATGGCAAACAGTACATGT | 80 | 5-8-5 | 835 |
| 620981 | 23631 | 23648 | AGGATTTAAGTGATTTTC | 66 | 5-8-5 | 836 |
| 620982 | 23826 | 23843 | TACAAAGACCCCTTTTCC | 51 | 5-8-5 | 837 |
| 620983 | 24016 | 24033 | AGCTGCCAGCAGTCCTTG | 81 | 5-8-5 | 838 |
| 620984 | 24196 | 24213 | CTGCTGTAGGAAATGACC | 77 | 5-8-5 | 839 |
| 620985 | 24377 | 24394 | AGCTCCAACCAGCTTTCT | 58 | 5-8-5 | 840 |
| 620986 | 24557 | 24574 | GTCCTGATTAACAGCTAA | 69 | 5-8-5 | 841 |
| 620987 | 24744 | 24761 | GTCTGTCTGCTGCCATCC | 81 | 5-8-5 | 842 |
| 620988 | 24924 | 24941 | GTAACTGATATGGTAACA | 85 | 5-8-5 | 843 |
| 620989 | 25286 | 25303 | AGCCCTCTTTGTACAGGA | 75 | 5-8-5 | 844 |
| 620990 | 25466 | 25483 | CTGTTCCAGTTGATCCAG | 53 | 5-8-5 | 845 |
| 620991 | 25668 | 25685 | GCAGTCTTTTTAAATTAA | 80 | 5-8-5 | 846 |
| 620992 | 25848 | 25865 | CCTCTGCTCACATAGAAA | 64 | 5-8-5 | 847 |
| 620993 | 26028 | 26045 | AGTACCTGCCTTGTTCCT | 52 | 5-8-5 | 848 |
| 620994 | 26208 | 26225 | AAGCATGGTAATACAAAA | 78 | 5-8-5 | 849 |
| 620995 | 26404 | 26421 | TTGATTAAAAAAATAGC | 4 | 5-8-5 | 850 |
| 620996 | 26584 | 26601 | TTCATCCTTTCCAAGTGT | 58 | 5-8-5 | 851 |
| 620997 | 26764 26948 | 26781 26965 | CATGCTTACACACCACAC | 23 | 5-8-5 | 852 |
| 620998 | 26762 26946 | 26779 26963 | TGCTTACACACCACACAC | 38 | 5-8-5 | 853 |
| 620999 | 27140 | 27157 | ATATGCTGAACACACACA | 75 | 5-8-5 | 854 |
| 621000 | 27320 | 27337 | CCACCGAGGTCTCATTGG | 52 | 5-8-5 | 855 |
| 621001 | 27500 | 27517 | GGGAGACCTCCCTTTCAA | 0 | 5-8-5 | 856 |
| 621002 | 27680 | 27697 | TCTCTGGGTGTAGAGACG | 54 | 5-8-5 | 857 |
| 621003 | 27861 | 27878 | GCAGGCTCGGGCTCCACG | 61 | 5-8-5 | 858 |
| 621004 | 28041 | 28058 | CCTTGTCAGATGGTTGAT | 55 | 5-8-5 | 859 |
| 621005 | 28221 | 28238 | TCTGCAGACTTTTCTCAA | 22 | 5-8-5 | 860 |
| 621006 | 28426 | 28443 | CTGGAGGGAGGTGATGTG | 7 | 5-8-5 | 861 |

TABLE 21-continued

Inhibition of Tau mRNA by 5-10-5 MOE and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 621007 | 28616 | 28633 | GAAAGCTGCTGCTGAGGG | 63 | 5-8-5 | 862 |
| 621008 | 28981 | 28998 | GGGCAAAGATAATTCGAA | 61 | 5-8-5 | 863 |
| 621009 | 29165 | 29182 | CCTCACCCTGGGCAAGAA | 68 | 5-8-5 | 864 |
| 621010 | 29409 | 29426 | TTGCTGCTCGGGAGGCCG | 14 | 5-8-5 | 865 |
| 621011 | 29589 | 29606 | AAATGAAAGATGCTGGCT | 23 | 5-8-5 | 866 |
| 621012 | 29953 | 29970 | CAGAGAGGTCCAGCTACT | 58 | 5-8-5 | 867 |
| 621013 | 30133 | 30150 | AGCTCACTACAGCAGGCA | 93 | 5-8-5 | 868 |
| 621014 | 30607 | 30624 | TATTTCTTGCAATTCTTT | 78 | 5-8-5 | 869 |
| 621015 | 30787 | 30804 | GGAGGACTGTCTCTAGAG | 59 | 5-8-5 | 870 |
| 621016 | 30967 | 30984 | TCCGGCCTGGCGAACTGA | 40 | 5-8-5 | 871 |
| 621017 | 31278 | 31295 | CCTGCAAAGCTAATTTTA | 18 | 5-8-5 | 872 |
| 621018 | 31458 | 31475 | GAGCCCCCTTTAAGCCTT | 65 | 5-8-5 | 873 |
| 621019 | 31654 | 31671 | GTACAAAGACTGTGTACG | 47 | 5-8-5 | 874 |
| 621020 | 31834 | 31851 | GACTCAGGAACATGTTAG | 81 | 5-8-5 | 875 |
| 621021 | 32023 | 32040 | TGAGGCAGCAATGCTGGG | 34 | 5-8-5 | 876 |
| 621022 | 32203 | 32220 | CACTGGGAGGTGTATAGA | 0 | 5-8-5 | 877 |
| 621023 | 32383 | 32400 | GCGAGGTGGGTGAAGGTT | 25 | 5-8-5 | 878 |
| 621024 | 32563 | 32580 | AAAAACTTTGGCAGTCAG | 80 | 5-8-5 | 879 |
| 621025 | 32743 | 32760 | GGTCTGCCCTGCACCAGG | 59 | 5-8-5 | 880 |
| 621026 | 32923 | 32940 | CTGAGCTCTCCGAGCTGC | 61 | 5-8-5 | 881 |
| 621027 | 33103 | 33120 | GTGAGGTGGTATCATTGG | 51 | 5-8-5 | 882 |
| 621028 | 33283 | 33300 | CTAGCTTGAATTCCTCCA | 81 | 5-8-5 | 883 |
| 621029 | 33463 | 33480 | AATCTGTGACTCAAGAAC | 47 | 5-8-5 | 884 |
| 621030 | 33708 | 33725 | GGGCCGTCTCTATTAAAA | 56 | 5-8-5 | 885 |
| 621031 | 33888 | 33905 | GGTATAATTTGTTTGGAC | 85 | 5-8-5 | 886 |
| 621032 | 34068 | 34085 | CTTTATTGCATATAGGTA | 86 | 5-8-5 | 887 |
| 621033 | 34248 | 34265 | ATCCAGTCCCAACATTGG | 30 | 5-8-5 | 888 |
| 621034 | 34428 | 34445 | CGGTCTCTCTGACTTGCC | 78 | 5-8-5 | 889 |
| 621035 | 34620 | 34637 | GAGGGCATTCCTCAAAGG | 10 | 5-8-5 | 890 |
| 621036 | 34800 | 34817 | AGTTCTCTGATTCTCAAA | 63 | 5-8-5 | 891 |
| 621037 | 34980 | 34997 | CCCCCAGTGCCCACAAGT | 48 | 5-8-5 | 892 |
| 621038 | 35160 | 35177 | CTAAAAGCTAAAGTGGGT | 49 | 5-8-5 | 893 |
| 621039 | 35340 | 35357 | AGGACCTGGCAGAGCTGC | 73 | 5-8-5 | 894 |
| 621040 | 35520 | 35537 | AAATCGAACACTTACATA | 20 | 5-8-5 | 895 |
| 621041 | 35721 | 35738 | TTGCCATCTTGGACAGGG | 89 | 5-8-5 | 896 |

TABLE 22

Inhibition of Tau mRNA by 5-10-5 and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 613412 | 73879 | 73898 | GTGATCTTCCATCACTTCGA | 85 | 5-10-5 | 25 |
| 620887 | 98891 98928 | 98908 98945 | GTTTTCAAACACACCTTC | 93 | 5-8-5 | 665 |
| 620888 | 98881 98918 | 98898 98935 | ACACCTTCATTTACTGTC | 95 | 5-8-5 | 897 |
| 620889 | 98890 98927 | 98907 98944 | TTTTCAAACACACCTTCA | 74 | 5-8-5 | 898 |
| 620890 | 98892 98929 | 98909 98946 | GGTTTTCAAACACACCTT | 96 | 5-8-5 | 899 |
| 620891 | 98893 98930 | 98910 98947 | TGGTTTTCAAACACACCT | 96 | 5-8-5 | 900 |
| 620892 | 6191 | 6208 | TACCTGATAGTCGACAGA | 53 | 5-8-5 | 901 |
| 620893 | 6371 | 6388 | GTCCCTTTCCAGGCCGCC | 70 | 5-8-5 | 902 |
| 620894 | 6551 | 6568 | CGCCCATTGCGGCAAAAG | 73 | 5-8-5 | 903 |
| 620895 | 6736 | 6753 | CACTGCTCGGGAGGTGCA | 62 | 5-8-5 | 904 |
| 620896 | 6938 | 6955 | TGTTCTCAGGCACGGCGC | 74 | 5-8-5 | 905 |
| 620897 | 7121 | 7138 | GCCCTGCGCTCCGAGCGC | 44 | 5-8-5 | 906 |
| 620898 | 7301 | 7318 | AAAAAAGATGGCACCTCG | 30 | 5-8-5 | 907 |
| 620899 | 7481 | 7498 | ACAAAGCAAAGAGCCCCC | 59 | 5-8-5 | 908 |
| 620900 | 7687 | 7704 | TCACGCCCGTTCCATGCG | 43 | 5-8-5 | 909 |
| 620901 | 7867 | 7884 | CCGGATGGGTAGCCAGCG | 47 | 5-8-5 | 910 |
| 620902 | 8047 | 8064 | CCCTCTCCGGACACCTGT | 69 | 5-8-5 | 911 |
| 620903 | 8227 | 8244 | AAATACACCCAGGGCCGC | 51 | 5-8-5 | 912 |
| 620904 | 8408 | 8425 | GATAGAATTAACCAGAAA | 33 | 5-8-5 | 913 |
| 620905 | 8588 | 8605 | AGCCTCGCAGTACCCAGG | 39 | 5-8-5 | 914 |
| 620906 | 8775 | 8792 | TCGCGAGATGGCAATACG | 55 | 5-8-5 | 915 |
| 620907 | 8956 | 8973 | TTCCTCCATTAACAGCGC | 49 | 5-8-5 | 916 |
| 620908 | 9157 | 9174 | CCCGCCTGCTGGGAATGG | 65 | 5-8-5 | 917 |
| 620909 | 9337 | 9354 | AGAACTCAAATTGGTCCT | 67 | 5-8-5 | 918 |
| 620910 | 9517 | 9534 | TATAAGCAGCTTATACAG | 34 | 5-8-5 | 919 |
| 620911 | 9697 | 9714 | CCAAGCCAGGTTATTGCT | 70 | 5-8-5 | 920 |
| 620912 | 9877 | 9894 | TCTAACAATTTATGGGCA | 81 | 5-8-5 | 921 |
| 620913 | 10057 | 10074 | AACAAATGGACTGTAACA | 59 | 5-8-5 | 922 |
| 620914 | 10240 | 10257 | TTCAAGGAGGGAGTAAGG | 12 | 5-8-5 | 923 |
| 620915 | 10420 | 10437 | AGGAAAGTGGTGGTGGAG | 22 | 5-8-5 | 924 |
| 620916 | 10600 | 10617 | TGCAGCCCAGCTGGTGAG | 35 | 5-8-5 | 925 |
| 620917 | 10781 | 10798 | TCCTTGTAGGATGTTTAA | 30 | 5-8-5 | 926 |
| 620918 | 10961 | 10978 | ACCTGCTACATAGCGGAA | 87 | 5-8-5 | 927 |

TABLE 22-continued

Inhibition of Tau mRNA by 5-10-5 and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 620919 | 11141 | 11158 | TTATAGATCATATCTGGG | 82 | 5-8-5 | 928 |
| 620920 | 11321 | 11338 | AAACAGAGCACCAATGTA | 36 | 5-8-5 | 929 |
| 620921 | 11501 | 11518 | ACCTCAGAGACTTGACCT | 54 | 5-8-5 | 930 |
| 620922 | 11681 | 11698 | CCCAGGAAGTGAGAAAAG | 20 | 5-8-5 | 931 |
| 620923 | 11864 | 11881 | CAGTTGGGAGCCATCTGG | 51 | 5-8-5 | 932 |
| 620924 | 12044 | 12061 | ATTGGGCTCAGCATGGAG | 30 | 5-8-5 | 933 |
| 620925 | 12224 | 12241 | TCCTTAACCATTAGGCCA | 70 | 5-8-5 | 934 |
| 620926 | 12404 | 12421 | TGGCCCTAGTGAGTACCG | 75 | 5-8-5 | 935 |
| 620927 | 12597 | 12614 | GCCCAGTTTGGTGCAGGG | 79 | 5-8-5 | 936 |
| 620928 | 12777 | 12794 | GGCGGGAAGGCAGGTCAG | 51 | 5-8-5 | 937 |
| 620929 | 12957 | 12974 | CAGTTTACCAATGTCAGC | 77 | 5-8-5 | 938 |
| 620930 | 13137 | 13154 | ATATATTGTTACTTAGTC | 83 | 5-8-5 | 939 |
| 620931 | 13317 | 13334 | CATAGGCAAAACAGACAA | 68 | 5-8-5 | 940 |
| 620932 | 13504 | 13521 | TAGTTGAATGTTTTGGAA | 73 | 5-8-5 | 941 |
| 620933 | 13702 | 13719 | ACGGCGGAGGCTGAGGCG | 10 | 5-8-5 | 942 |
| 620934 | 13882 | 13899 | AGGTGCAAGCTGGCCGGG | 44 | 5-8-5 | 943 |
| 620935 | 14062 | 14079 | TGATACCCTGTAAGAATA | 82 | 5-8-5 | 944 |
| 620936 | 14243 | 14260 | AATATAGCAAAGGGAATT | 54 | 5-8-5 | 945 |
| 620937 | 14423 | 14440 | TAGAGATAATTATGTCCC | 73 | 5-8-5 | 946 |
| 620938 | 14609 | 14626 | GCAATTACAGAGCCAGGG | 76 | 5-8-5 | 947 |
| 620939 | 14789 | 14806 | GCAGAACTGGATCCGATC | 69 | 5-8-5 | 948 |
| 620940 | 15035 | 15052 | CAAAGCCAGGATGGTCTC | 92 | 5-8-5 | 949 |
| 620941 | 15246 | 15263 | CCAAAGAGATTCCTTTTT | 79 | 5-8-5 | 950 |
| 620942 | 15924 | 15941 | GGCCTCATTTATATATAT | 20 | 5-8-5 | 951 |
| 620943 | 16156 | 16173 | TATGGGACAATCATAGCT | 56 | 5-8-5 | 952 |
| 620944 | 16336 | 16353 | AATTCTGATACATTGTCA | 81 | 5-8-5 | 953 |
| 620945 | 16516 | 16533 | GATGACTCTTCCAAATGG | 70 | 5-8-5 | 954 |
| 620946 | 16696 | 16713 | TCACTTCATTATTCAAGC | 84 | 5-8-5 | 955 |
| 620947 | 16876 | 16893 | GTGCAGCCGCCACTGGCC | 86 | 5-8-5 | 956 |
| 620948 | 17085 | 17102 | CGATAAGATCTTTTTAAA | 25 | 5-8-5 | 957 |
| 620949 | 17266 | 17283 | GACAGTATAATCTCCATT | 69 | 5-8-5 | 958 |
| 620950 | 17446 | 17463 | AGGCTAAAGTCAGCCCAC | 29 | 5-8-5 | 959 |
| 620951 | 17639 | 17656 | CTTGCACCCTGGTTTGGG | 40 | 5-8-5 | 960 |
| 620952 | 17819 | 17836 | TCCCTGTCTGGTTAGGAA | 80 | 5-8-5 | 961 |
| 620953 | 17999 | 18016 | ACGCGCCTGCCCCGTGCC | 50 | 5-8-5 | 962 |
| 620954 | 18179 | 18196 | CTCAAACCTGGCCACGCT | 64 | 5-8-5 | 963 |

TABLE 22-continued

Inhibition of Tau mRNA by 5-10-5 and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 620955 | 18359 | 18376 | GAAACTGGCGGGTCTGTT | 64 | 5-8-5 | 964 |
| 620956 | 18539 | 18556 | GGGAGGAATTTGGCAATG | 37 | 5-8-5 | 965 |
| 620957 | 18719 | 18736 | AAAGAGCACGGCATCTAT | 76 | 5-8-5 | 966 |
| 620958 | 18905 | 18922 | AAACTGTGAGGCACTGGG | 87 | 5-8-5 | 967 |
| 620959 | 19088 | 19105 | CATTTGACATTGGCCTGT | 72 | 5-8-5 | 968 |
| 620960 | 19283 | 19300 | ATTATTATCAGCATCTTC | 77 | 5-8-5 | 969 |
| 620961 | 19467 | 19484 | TTGCAGAGGCAGGAAGGC | 67 | 5-8-5 | 970 |
| 620962 | 19647 | 19664 | AGCAGCCTGGTTTAGAGG | 31 | 5-8-5 | 971 |
| 620963 | 19827 | 19844 | TCCACATCTTCCAGCCTC | 74 | 5-8-5 | 972 |
| 620964 | 20007 | 20024 | ATACAGACTCAGTCTCCT | 79 | 5-8-5 | 973 |

TABLE 23

Inhibition of Tau mRNA by 5-10-5 and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 613412 | 73879 | 73898 | GTGATCTTCCATCACTTCGA | 78 | 5-10-5 | 25 |
| 620887 | 98891 98928 | 98908 98945 | GTTTTCAAACACACCTTC | 93 | 5-8-5 | 665 |
| 621042 | 35901 | 35918 | AGTCGACCGCACTCCTGC | 42 | 5-8-5 | 974 |
| 621043 | 36106 | 36123 | GCCCTGAGGGTCCACAGG | 20 | 5-8-5 | 975 |
| 621044 | 36286 | 36303 | AGGGCAGTGTCCTACCTC | 50 | 5-8-5 | 976 |
| 621045 | 36466 | 36483 | GTCCTCCCTTCCCCACAA | 29 | 5-8-5 | 977 |
| 621046 | 36653 | 36670 | CTGAATTCCTATCATGCG | 51 | 5-8-5 | 978 |
| 621047 | 36833 | 36850 | GAGAAAGAAGAGTGTGGT | 23 | 5-8-5 | 979 |
| 621048 | 37024 | 37041 | CTTAGGACAGATTCCTAG | 29 | 5-8-5 | 980 |
| 621049 | 37204 | 37221 | GTCAGAAGTGTTTTCCCA | 80 | 5-8-5 | 981 |
| 621050 | 37413 | 37430 | TCCAATTTTAAACTTAAA | 28 | 5-8-5 | 982 |
| 621051 | 37750 | 37767 | CTACTGTTTAAAAAGGCT | 66 | 5-8-5 | 983 |
| 621052 | 38013 | 38030 | GTAAACACCATCTCTAAA | 19 | 5-8-5 | 984 |
| 621053 | 38193 | 38210 | CTCTGATACTATTATAAG | 31 | 5-8-5 | 985 |
| 621054 | 38374 | 38391 | CTGAGCTATTTGAGAATT | 21 | 5-8-5 | 986 |
| 621055 | 38557 | 38574 | TCTGCATATATAATTATA | 57 | 5-8-5 | 987 |
| 621056 | 38737 | 38754 | CACATTGTTTAGATTTTC | 79 | 5-8-5 | 988 |
| 621057 | 38922 | 38939 | TTAGCACACCTGAAACGC | 51 | 5-8-5 | 989 |

TABLE 23-continued

Inhibition of Tau mRNA by 5-10-5 and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 621058 | 39102 | 39119 | GGCAAAGAAGACAGGAGA | 68 | 5-8-5 | 990 |
| 621059 | 39541 | 39558 | TGCTGAGGATGCTTTTTT | 72 | 5-8-5 | 991 |
| 621060 | 39721 | 39738 | GCTGGAAGATGAGGTGGT | 47 | 5-8-5 | 992 |
| 621061 | 39901 | 39918 | TGGGTGTTGGAGAAAACT | 24 | 5-8-5 | 993 |
| 621062 | 40100 | 40117 | GCTTTAAAAGCTCCTCAG | 65 | 5-8-5 | 994 |
| 621063 | 40347 | 40364 | CGAGCACTTGTAGTTCCA | 35 | 5-8-5 | 995 |
| 621064 | 40528 | 40545 | GCAGTGCTTTAAAAATAT | 22 | 5-8-5 | 996 |
| 621065 | 40709 | 40726 | GAAATTTCATGAAATATG | 37 | 5-8-5 | 997 |
| 621066 | 40889 | 40906 | TTACTTGCAATTGAAAGA | 6 | 5-8-5 | 998 |
| 621067 | 41069 | 41086 | GGAAAGACTACTCAGAGC | 57 | 5-8-5 | 999 |
| 621068 | 41249 | 41266 | GATGAAAGAGAATAACAA | 20 | 5-8-5 | 1000 |
| 621069 | 41429 | 41446 | ACCCATTATCTGCTCCCC | 66 | 5-8-5 | 1001 |
| 621070 | 41611 | 41628 | TTTTCAGTAACAACATAA | 51 | 5-8-5 | 1002 |
| 621071 | 41944 | 41961 | CCTTTAGCTTTCCTTTTC | 47 | 5-8-5 | 1003 |
| 621072 | 42124 | 42141 | CAAATTCTGTTTCTGTAA | 47 | 5-8-5 | 1004 |
| 621073 | 42304 | 42321 | GCAAAAATAAGTGAACTG | 38 | 5-8-5 | 1005 |
| 621074 | 42492 | 42509 | TTGCAGTGACTTCTTGGG | 71 | 5-8-5 | 1006 |
| 621075 | 42672 | 42689 | AAACCCCTTCAACATCAG | 45 | 5-8-5 | 1007 |
| 621076 | 42853 | 42870 | ACAAGAGAAACATTTTAC | 53 | 5-8-5 | 1008 |
| 621077 | 43033 | 43050 | CACTTAGTAACCAAGCAA | 53 | 5-8-5 | 1009 |
| 621078 | 43213 | 43230 | CATAGATGATATATTTTG | 78 | 5-8-5 | 1010 |
| 621079 | 43393 | 43410 | AAATCTTGAACTCCTGAA | 58 | 5-8-5 | 1011 |
| 621080 | 43620 | 43637 | GGAGTTTTTGTGTTTCTT | 77 | 5-8-5 | 1012 |
| 621081 | 43804 | 43821 | AAATTCTTAATGGTTCAG | 75 | 5-8-5 | 1013 |
| 621082 | 44051 | 44068 | AGATAGATCTCGGCTCAC | 81 | 5-8-5 | 1014 |
| 621083 | 44231 | 44248 | AACCTTTAATAAACTTTT | 43 | 5-8-5 | 1015 |
| 621084 | 44617 | 44634 | GTCCAAGAGGTTTTTTTT | 41 | 5-8-5 | 1016 |
| 621085 | 44809 | 44826 | GCAGTCACTGCATTCCAG | 27 | 5-8-5 | 1017 |
| 621086 | 45050 | 45067 | CAAAAACAGGGCTAGGCA | 21 | 5-8-5 | 1018 |
| 621087 | 45230 | 45247 | TTCCCTGAACAAATGGCA | 59 | 5-8-5 | 1019 |
| 621088 | 45412 | 45429 | CTCAAATGTAACATTTTA | 84 | 5-8-5 | 1020 |
| 621089 | 45592 | 45609 | TACACCTGGCCCATGACC | 41 | 5-8-5 | 1021 |
| 621090 | 45772 | 45789 | AAGTTCTGGCTCAAGCAA | 21 | 5-8-5 | 1022 |
| 621091 | 45955 | 45972 | ACAACTCTCTGGAAAAAA | 30 | 5-8-5 | 1023 |
| 621092 | 46135 | 46152 | AGTCCACGCCTGCATCTG | 63 | 5-8-5 | 1024 |

TABLE 23-continued

Inhibition of Tau mRNA by 5-10-5 and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 621093 | 46315 | 46332 | CAAGGCAACAGAGAGGCA | 42 | 5-8-5 | 1025 |
| 621094 | 46495 | 46512 | AACATGCATATAATTACC | 40 | 5-8-5 | 1026 |
| 621095 | 46675 | 46692 | TTGGAGGGACAATTCTCA | 46 | 5-8-5 | 1027 |
| 621096 | 46855 | 46872 | CGAAGAGGCCAGGACTGC | 34 | 5-8-5 | 1028 |
| 621097 | 47036 | 47053 | TTTGGCTCTGGTGATGGT | 45 | 5-8-5 | 1029 |
| 621098 | 47216 | 47233 | ACCAGGCAAAGGGACACC | 68 | 5-8-5 | 1030 |
| 621099 | 47396 | 47413 | TGCCAGAGACAGAGGTTG | 68 | 5-8-5 | 1031 |
| 621100 | 47576 | 47593 | CACACGCATGGCTTCATG | 55 | 5-8-5 | 1032 |
| 621101 | 47756 | 47773 | GAGGAAGGCATGAACTAA | 60 | 5-8-5 | 1033 |
| 621102 | 47936 | 47953 | TCCCATGCCCACGCATGT | 26 | 5-8-5 | 1034 |
| 621103 | 48116 | 48133 | ATTATTAACGAACAAAAA | 2 | 5-8-5 | 1035 |
| 621104 | 48302 | 48319 | ATGTCCAGATGTGGATCG | 52 | 5-8-5 | 1036 |
| 621105 | 48482 | 48499 | ATCAGACAGAAGAGCCAT | 55 | 5-8-5 | 1037 |
| 621106 | 48678 | 48695 | GCACAGTGCAACAGTGGG | 78 | 5-8-5 | 1038 |
| 621107 | 49171 | 49188 | GGCTTTCCCTTCCCTTCT | 33 | 5-8-5 | 1039 |
| 621108 | 49361 | 49378 | AGCTGGGAAAGTGGCAGG | 23 | 5-8-5 | 1040 |
| 621109 | 49561 | 49578 | ATGACAACTTGATTTGGG | 65 | 5-8-5 | 1041 |
| 621110 | 49741 | 49758 | GACCGCAACCTTGCCAAA | 43 | 5-8-5 | 1042 |
| 621111 | 50111 | 50128 | CTTTCAGAGACAGGCTCG | 41 | 5-8-5 | 1043 |
| 621112 | 50298 | 50315 | GGGCTCACCCCTGTAGTT | 9 | 5-8-5 | 1044 |
| 621113 | 50766 | 50783 | CTCTTAAGGCCGAGTGCA | 39 | 5-8-5 | 1045 |
| 621114 | 50970 | 50987 | TGCTAGGCAAAAAAACAA | 35 | 5-8-5 | 1046 |
| 621115 | 51150 | 51167 | TAATTAGAAACCTCCTCG | 10 | 5-8-5 | 1047 |
| 621116 | 51330 | 51347 | CAGGTCATATATGAAATC | 33 | 5-8-5 | 1048 |
| 621117 | 51521 | 51538 | TGTGCTTCCGAAAGTAGT | 63 | 5-8-5 | 1049 |
| 621118 | 51702 | 51719 | GCATCAAATCCATGCATT | 38 | 5-8-5 | 1050 |

TABLE 24

Inhibition of tau mRNA by 5-10-5 and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 613412 | 73879 | 73898 | GTGATCTTCCATCACTTCGA | 71 | 5-10-5 | 25 |
| 620887 | 98891 98928 | 98908 98945 | GTTTTCAAACACACCTTC | 84 | 5-8-5 | 665 |

TABLE 24-continued

Inhibition of tau mRNA by 5-10-5 and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 621119 | 51894 | 51911 | ACTCTGAAGCACAGACAG | 21 | 5-8-5 | 1051 |
| 621120 | 52081 | 52098 | CTTACCTGGGCTGGATGG | 5 | 5-8-5 | 1052 |
| 621121 | 52261 | 52278 | TTCTGTCTATAGCTAGAA | 32 | 5-8-5 | 1053 |
| 621122 | 52441 | 52458 | AGATGGCTTCCTATTGTT | 32 | 5-8-5 | 1054 |
| 621123 | 52621 | 52638 | TGGTTTGGTCAGGCCTCA | 51 | 5-8-5 | 1055 |
| 621124 | 52803 | 52820 | ATTGTAACTCAAAGTGGG | 50 | 5-8-5 | 1056 |
| 621125 | 53004 | 53021 | AAACTCTACACCCCTGGG | 17 | 5-8-5 | 1057 |
| 621126 | 53264 | 53281 | CATACCAGGAAGGAAGGA | 17 | 5-8-5 | 1058 |
| 621127 | 53444 | 53461 | TGGACATATCAGAATTTG | 64 | 5-8-5 | 1059 |
| 621128 | 53624 | 53641 | CCCTTATTAGTGTCTACA | 68 | 5-8-5 | 1060 |
| 621129 | 53805 | 53822 | ACACTCTAGAGAGGTCCA | 68 | 5-8-5 | 1061 |
| 621130 | 53985 | 54002 | GACAGTACCCACGACACG | 32 | 5-8-5 | 1062 |
| 621131 | 54165 | 54182 | CCCCATTCTGGATCCTGG | 40 | 5-8-5 | 1063 |
| 621132 | 54348 | 54365 | ATTGTCTGTAAAATGTGG | 57 | 5-8-5 | 1064 |
| 621133 | 54528 | 54545 | ATTCTGTCTGACAGAGAC | 40 | 5-8-5 | 1065 |
| 621134 | 54711 | 54728 | CGATGGTGCACATCTATA | 45 | 5-8-5 | 1066 |
| 621135 | 54891 | 54908 | CAGTGTCCGCTGAACACA | 37 | 5-8-5 | 1067 |
| 621136 | 55073 | 55090 | AGGAGGATTAGGAAGAAA | 14 | 5-8-5 | 1068 |
| 621137 | 55261 | 55278 | CAAGGAAGGCGATCTGGG | 17 | 5-8-5 | 1069 |
| 621138 | 55623 | 55640 | GGTGGCACTTGAACAAGC | 61 | 5-8-5 | 1070 |
| 621139 | 55803 | 55820 | GGTGGAAAGGGAACCCGG | 43 | 5-8-5 | 1071 |
| 621140 | 55983 | 56000 | CCCCACGGGTACACAGAG | 20 | 5-8-5 | 1072 |
| 621141 | 56163 | 56180 | CGCTGCGAACGATGCACT | 63 | 5-8-5 | 1073 |
| 621142 | 56343 | 56360 | GAATGGTCCTTCTTACAG | 13 | 5-8-5 | 1074 |
| 621143 | 56526 | 56543 | CTGGGAAAACCAAGGCAA | 57 | 5-8-5 | 1075 |
| 621144 | 56706 | 56723 | CCCAGGCTGAGGAAGGAC | 40 | 5-8-5 | 1076 |
| 621145 | 56886 | 56903 | GATTGGCTTTTACATCTT | 48 | 5-8-5 | 1077 |
| 621146 | 57289 | 57306 | CGGTTTGAGTACAGTGGT | 50 | 5-8-5 | 1078 |
| 621147 | 57470 | 57487 | CTAACATCTTAGGGCACA | 73 | 5-8-5 | 1079 |
| 621148 | 57650 | 57667 | TTCCTCTGATGTCAGAAT | 51 | 5-8-5 | 1080 |
| 621149 | 58090 | 58107 | CCCCCTCGGTCGCCCAGG | 37 | 5-8-5 | 1081 |
| 621150 | 58271 | 58288 | TGTTTTAACTAAAAGCTT | 24 | 5-8-5 | 1082 |
| 621151 | 58451 | 58468 | GTATGAGGGCATAGATGA | 26 | 5-8-5 | 1083 |
| 621152 | 58631 | 58648 | ATCACACCACAGAATGTT | 29 | 5-8-5 | 1084 |
| 621153 | 58812 | 58829 | TACTCTTCTGTGGCAGCT | 66 | 5-8-5 | 1085 |
| 621154 | 59198 | 59215 | CAACAGCAAGGCCAGGCG | 44 | 5-8-5 | 1086 |

TABLE 24-continued

Inhibition of tau mRNA by 5-10-5 and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 621155 | 59380 | 59397 | TAGATAATTTGAAATTTA | 0 | 5-8-5 | 1087 |
| 621156 | 59786 | 59803 | ACCTTAATCCCAGTATTT | 12 | 5-8-5 | 1088 |
| 621157 | 59966 | 59983 | TGCTTATGGTCCAGCTGT | 40 | 5-8-5 | 1089 |
| 621158 | 60146 | 60163 | GAGCCAGGCTTCAAAACC | 26 | 5-8-5 | 1090 |
| 621159 | 60326 | 60343 | TCCAGCACATTTAGGCGG | 32 | 5-8-5 | 1091 |
| 621160 | 60522 | 60539 | ATCTCAATAAAGCTATCG | 70 | 5-8-5 | 1092 |
| 621161 | 60702 | 60719 | CGCCCGCGGTGACTCAGC | 32 | 5-8-5 | 1093 |
| 621162 | 60906 | 60923 | GGAGTCAAGAGTCCAGGG | 44 | 5-8-5 | 1094 |
| 621163 | 61109 | 61126 | AGAAGGAATGATGAGGAA | 24 | 5-8-5 | 1095 |
| 621164 | 61290 | 61307 | GCAGTACAGTTTGGTAAT | 32 | 5-8-5 | 1096 |
| 621165 | 61476 | 61493 | TGGCTACTCTCTCAGGAG | 9 | 5-8-5 | 1097 |
| 621166 | 61656 | 61673 | GACCCTAGGTGGGTAAAG | 21 | 5-8-5 | 1098 |
| 621167 | 61836 | 61853 | GTCCCCTGAGGTGTTGTG | 0 | 5-8-5 | 1099 |
| 621168 | 62016 | 62033 | CCCAGACAACCTTCACCT | 34 | 5-8-5 | 1100 |
| 621169 | 62208 | 62225 | TGGGTTAAGACTCTGTCT | 11 | 5-8-5 | 1101 |
| 621170 | 62467 | 62484 | TGGAGCCGAGTGCGGTGG | 12 | 5-8-5 | 1102 |
| 621171 | 62657 | 62674 | TCTCTTCTGGATATTTCG | 49 | 5-8-5 | 1103 |
| 621172 | 62843 | 62860 | CGATTTAAAATGAATGAT | 20 | 5-8-5 | 1104 |
| 621173 | 63023 | 63040 | AGAACAAAGATAACAGTT | 0 | 5-8-5 | 1105 |
| 621174 | 63218 | 63235 | GCTAAATTGAGGCCCGGG | 42 | 5-8-5 | 1106 |
| 621175 | 63398 | 63415 | CTTTCTCCTTTCCTCAAT | 26 | 5-8-5 | 1107 |
| 621176 | 63578 | 63595 | TCTAAGCGAGACACACAG | 26 | 5-8-5 | 1108 |
| 621177 | 63758 | 63775 | TGATTTCTCTGGAAGAAC | 27 | 5-8-5 | 1109 |
| 621178 | 63938 | 63955 | GCCTGTGTCTTCTAACTC | 32 | 5-8-5 | 1110 |
| 621179 | 64184 | 64201 | GGCTGAGAAGCTGGGACC | 40 | 5-8-5 | 1111 |
| 621180 | 64365 | 64382 | TTTTTACTTGAGATGTCA | 38 | 5-8-5 | 1112 |
| 621181 | 64543 | 64560 | GTAGGTGTCATCATCATC | 83 | 5-8-5 | 1113 |
| 621182 | 64723 | 64740 | CAACACTGACTGAGCACA | 56 | 5-8-5 | 1114 |
| 621183 | 64903 | 64920 | GCATTGGCTGGGCTAGGT | 73 | 5-8-5 | 1115 |
| 621184 | 65092 | 65109 | TATTTACTATGCAAAATA | 18 | 5-8-5 | 1116 |
| 621185 | 65273 | 65290 | AGCACCACAGAGCAGATG | 19 | 5-8-5 | 1117 |
| 621186 | 65453 | 65470 | CTCAGTGTGGAGTTCTGC | 44 | 5-8-5 | 1118 |
| 621187 | 65634 | 65651 | CATTTTTCAACCACTTAA | 44 | 5-8-5 | 1119 |
| 621188 | 65815 | 65832 | GTAAGGCTTTGTGGGCCA | 32 | 5-8-5 | 1120 |
| 621189 | 66148 | 66165 | TACTTTGCATTATTTATT | 44 | 5-8-5 | 1121 |

TABLE 24-continued

Inhibition of tau mRNA by 5-10-5 and 5-8-5 MOE gapmers targeting SEQ ID NO: 1

| ISIS NO | SEQ ID NO: 1 Start Site | SEQ ID NO: 1 Stop Site | Sequence | % inhibition | Motif | SEQ ID NO |
|---|---|---|---|---|---|---|
| 621190 | 66535 | 66552 | TTGGCTTTCATTATAATT | 13 | 5-8-5 | 1122 |
| 621191 | 66736 | 66753 | GGACGGTTGGGAAATAGG | 18 | 5-8-5 | 1123 |
| 621192 | 66916 | 66933 | GAGCAACTGTTCATAGGG | 49 | 5-8-5 | 1124 |
| 621193 | 67096 | 67113 | TCTGCACATCGACACATC | 34 | 5-8-5 | 1125 |
| 621194 | 67538 | 67555 | AGGCTAGGCCCCATGGCT | 21 | 5-8-5 | 1126 |
| 621195 | 67718 | 67735 | GCACCCCATCCTTCAGC | 30 | 5-8-5 | 1127 |

TABLE 25

Inhibition of Tau mRNA by 5-10-5 and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 613412 | 73879 | 73898 | GTGATCTTCCATCACTTCGA | 87 | 5-10-5 | 25 |
| 620887 | 98891 98928 | 98908 98945 | GTTTTCAAACACACCTTC | 96 | 5-8-5 | 665 |
| 621350 | 99702 | 99719 | CCAGGAGATGAAGTAGCA | 75 | 5-8-5 | 1128 |
| 621351 | n/a | n/a | ACTCTTGGGAAACAAAGT | 31 | 5-8-5 | 1129 |
| 621352 | 100065 | 100082 | GGAAGCAGCCAGGGACGG | 38 | 5-8-5 | 1130 |
| 621353 | 100288 | 100305 | CTGCCTGGCCAATTAAAT | 28 | 5-8-5 | 1131 |
| 621354 | 100468 | 100485 | CAAACTAATATTAACACT | 0 | 5-8-5 | 1132 |
| 621355 | 100648 | 100665 | TACTCAATTCCAGGCAAG | 71 | 5-8-5 | 1133 |
| 621356 | 100836 | 100853 | AATGGAAGTTCTAGTACG | 57 | 5-8-5 | 1134 |
| 621357 | 101188 | 101205 | CAATCACAGTTCTTTTTC | 45 | 5-8-5 | 1135 |
| 621358 | 101381 | 101398 | GTCTTAAACATAAACATA | 77 | 5-8-5 | 1136 |
| 621359 | 101759 | 101776 | TGAGAGGGATGGCCCCCA | 67 | 5-8-5 | 1137 |
| 621360 | n/a | n/a | CGCATAACACCACGCCCG | 90 | 5-8-5 | 1138 |
| 621361 | 102169 | 102186 | GCCAAAATCAGGAATGGG | 94 | 5-8-5 | 1139 |
| 621362 | 102349 | 102366 | GGCAGTCCCTGGGTTCCG | 77 | 5-8-5 | 1140 |
| 621363 | 102529 | 102546 | GTTGAACCTGACCAAGGA | 89 | 5-8-5 | 1141 |
| 621364 | 102709 | 102726 | AGCATGAGTTGTGCCAAG | 89 | 5-8-5 | 1142 |
| 621365 | 102889 | 102906 | CCCACTCCGCCACCTTGA | 67 | 5-8-5 | 1143 |
| 621366 | 103091 | 103108 | TACCAGAGCTGGGTGGTG | 13 | 5-8-5 | 1144 |
| 621367 | 103271 | 103288 | ACATTTGCCTCAGAAATC | 5 | 5-8-5 | 1145 |
| 621368 | 103593 | 103610 | GATTCAGGCTGGGAGTGG | 11 | 5-8-5 | 1146 |
| 621369 | 103773 | 103790 | CTCCGAGAGCTGCCACTT | 51 | 5-8-5 | 1147 |
| 621370 | 103966 | 103983 | TGCAGCAGACTCCTAACG | 33 | 5-8-5 | 1148 |

TABLE 25-continued

Inhibition of Tau mRNA by 5-10-5 and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 621371 | 104389 | 104406 | AGGAATCTCACTTTTGTC | 25 | 5-8-5 | 1149 |
| 621372 | 104569 | 104586 | AGGCTGCCCGTGCCACCA | 30 | 5-8-5 | 1150 |
| 621373 | 104749 | 104766 | TTAGTGAATGGCCATCCT | 33 | 5-8-5 | 1151 |
| 621374 | 105023 | 105040 | AAACTGCTTGAATTTGGG | 31 | 5-8-5 | 1152 |
| 621375 | 105203 | 105220 | TGTGAGTCCCCTGTAATC | 18 | 5-8-5 | 1153 |
| 621376 | 105383 | 105400 | TAAACAGGGCCTTAATGA | 0 | 5-8-5 | 1154 |
| 621377 | 105563 | 105580 | TCCTCCCGGCTCTAGAAA | 10 | 5-8-5 | 1155 |
| 621378 | 105745 | 105762 | GGAGACAGCCAGGCATGG | 18 | 5-8-5 | 1156 |
| 621379 | 106173 | 106190 | ATAATGTTTTTTATAGAG | 0 | 5-8-5 | 1157 |
| 621380 | 106365 | 106382 | GACTGGATTTTTGTATTT | 30 | 5-8-5 | 1158 |
| 621381 | 106545 | 106562 | CGGAGTCTTATTCTGATG | 39 | 5-8-5 | 1159 |
| 621382 | 106725 | 106742 | CCGCAGCAATGCCCCTGC | 65 | 5-8-5 | 1160 |
| 621383 | 106905 | 106922 | TCTCGATCCCCTTCAAGA | 23 | 5-8-5 | 1161 |
| 621384 | 107085 | 107102 | CTGGGTGTCCTTTACCCT | 5 | 5-8-5 | 1162 |
| 621385 | 107265 | 107282 | CCTGCTCCACGCCTGCCT | 82 | 5-8-5 | 1163 |
| 621386 | 107445 | 107462 | TCAGGGCCTTTATCCTAA | 51 | 5-8-5 | 1164 |
| 621387 | 107625 | 107642 | TCGGCTCCACAGTCTTTG | 60 | 5-8-5 | 1165 |
| 621388 | 107805 | 107822 | CACCACTGGGTTAGGCAG | 38 | 5-8-5 | 1166 |
| 621389 | 108170 | 108187 | TCACCTTCCCGCCTCCCG | 16 | 5-8-5 | 1167 |
| 621390 | 108359 | 108376 | TTGAAGAGGGTCCAGAGG | 3 | 5-8-5 | 1168 |
| 621391 | 108548 | 108565 | TGCCCAGAAGGCAGGTGG | 38 | 5-8-5 | 1169 |
| 621392 | 108728 | 108745 | GGCCCCGAAGTCTGTGC | 62 | 5-8-5 | 1170 |
| 621393 | 108908 | 108925 | CGGTGCAGGACAGAGGTG | 57 | 5-8-5 | 1171 |
| 621394 | 109135 | 109152 | CGCGCACCACCACCACGC | 78 | 5-8-5 | 1172 |
| 621395 | 109315 | 109332 | TCAGGCTGGGCCCTAAGC | 50 | 5-8-5 | 1173 |
| 621396 | 109495 | 109512 | TCACCCTTCCCCAGCTCC | 45 | 5-8-5 | 1174 |
| 621397 | 109675 | 109692 | TCAGACCCAAGTGATAAG | 64 | 5-8-5 | 1175 |
| 621398 | 109855 | 109872 | GCAGGGTCTACACATGCG | 76 | 5-8-5 | 1176 |
| 621399 | 110045 | 110062 | CTGAGATGTTCTCTTCCT | 73 | 5-8-5 | 1177 |
| 621400 | 110225 | 110242 | AGCTGCGGTACAGGACAG | 68 | 5-8-5 | 1178 |
| 621401 | 110405 | 110422 | CCAGTGAGGGCCCCTCTG | 20 | 5-8-5 | 1179 |
| 621402 | 110585 | 110602 | GCCCCCAGAGGTGCATGG | 58 | 5-8-5 | 1180 |
| 621403 | 110769 | 110786 | GGAGCAGCAGACACATGC | 79 | 5-8-5 | 1181 |
| 621404 | 110949 | 110966 | GGAAGCTACTTCCCATGC | 43 | 5-8-5 | 1182 |
| 621406 | 111495 | 111512 | GGAGGAGGCCTGACACCC | 58 | 5-8-5 | 1183 |
| 621407 | 111675 | 111692 | TTTCCCTTTGGTGTTAGC | 91 | 5-8-5 | 1184 |
| 621408 | 111856 | 111873 | CCCCAAAGCAATCTATGT | 47 | 5-8-5 | 1185 |

TABLE 25-continued

Inhibition of Tau mRNA by 5-10-5 and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 621409 | 112036 | 112053 | TCTGGAGGGAACACTGCC | 60 | 5-8-5 | 1186 |
| 621410 | 112216 | 112233 | GGTTGAGGTTGAGGGTAG | 37 | 5-8-5 | 1187 |
| 621411 | 112396 | 112413 | ACTCCCGCAGGCCAAACA | 36 | 5-8-5 | 1188 |
| 621412 | 112603 | 112620 | GAGTGCCAACAGGCCCAG | 75 | 5-8-5 | 1189 |
| 621413 | 112784 | 112801 | TTCTAAGTACAATTTGGG | 67 | 5-8-5 | 1190 |
| 621414 | 112984 | 113001 | TTACTGGTTGTGTTTTCT | 94 | 5-8-5 | 1191 |
| 621415 | 113164 | 113181 | GAGTCTCAGTCTCACTGT | 76 | 5-8-5 | 1192 |
| 621416 | 113347 | 113364 | CATTCCTCCTGCTGCTGT | 83 | 5-8-5 | 1193 |
| 621417 | 113540 | 113557 | GCTCTGAAGAGCTCCACG | 83 | 5-8-5 | 1194 |
| 621418 | 113720 | 113737 | CTCTCTTCAGGGCCACCG | 82 | 5-8-5 | 1195 |
| 621419 | 113900 | 113917 | CTCTCTCGCCCTGCATGG | 48 | 5-8-5 | 1196 |
| 621420 | 114080 | 114097 | CTGGACATCCTCCGAGAA | 27 | 5-8-5 | 1197 |
| 621421 | 114260 | 114277 | CACCCAGGCTGCGGCCCA | 64 | 5-8-5 | 1198 |
| 621422 | 114440 | 114457 | CTGTGGTGCAAGCCTGTG | 42 | 5-8-5 | 1199 |
| 621423 | 114639 | 114656 | AGACGAGAGTGCGCCCAC | 78 | 5-8-5 | 1200 |
| 621424 | 115155 | 115172 | CCACATAAATGTTCTACA | 94 | 5-8-5 | 1201 |
| 621425 | 115335 | 115352 | GGTACAGGAAAAGATGCC | 88 | 5-8-5 | 1202 |
| 621426 | 115515 | 115532 | ATCAGCTTAGGAACTGAC | 85 | 5-8-5 | 1203 |

TABLE 26

Inhibition of tau mRNA by 5-10-5 and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 613412 | 73879 | 73898 | GTGATCTTCCATCACTTCGA | 86 | 5-10-5 | 25 |
| 620887 | 98891 98928 | 98908 98945 | GTTTTCAAACACACCTTC | 97 | 5-8-5 | 665 |
| 621427 | 115695 | 115712 | GTGCCTCACAGTTGGCTC | 39 | 5-8-5 | 1204 |
| 621428 | 115896 | 115913 | GAGAGGCTGTGGTGAGGT | 25 | 5-8-5 | 1205 |
| 621429 | 116077 | 116094 | GAAATCAGAATCCTGAAA | 66 | 5-8-5 | 1206 |
| 621430 | 116259 | 116276 | ATGTGGCTTTTTCTTGTT | 64 | 5-8-5 | 1207 |
| 621431 | 116595 | 116612 | GTTTTTTTCTGGCCGGGC | 90 | 5-8-5 | 1208 |
| 621432 | 116955 | 116972 | TTTTCAGTGGATAAGGCT | 78 | 5-8-5 | 1209 |
| 621433 | 117135 | 117152 | ACATAAACTCCTTCTTTG | 53 | 5-8-5 | 1210 |
| 621434 | 117315 | 117332 | TGGTGAATGTTGAATTC | 78 | 5-8-5 | 1211 |
| 621435 | 117495 | 117512 | AGGACAAGGAGGCCATGT | 56 | 5-8-5 | 1212 |
| 621436 | 117787 | 117804 | TCAAATGACAGATTCTCA | 78 | 5-8-5 | 1213 |

TABLE 26-continued

Inhibition of tau mRNA by 5-10-5 and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 621437 | 117967 | 117984 | CATCCCTACTTTCTCCCT | 24 | 5-8-5 | 1214 |
| 621438 | 118420 | 118437 | TAGAATCTTGCCTTGTCG | 34 | 5-8-5 | 1215 |
| 621439 | 118600 | 118617 | GATACAGACATACATTGT | 68 | 5-8-5 | 1216 |
| 621440 | 118831 | 118848 | AATTCTTTGTGATGATGG | 82 | 5-8-5 | 1217 |
| 621441 | 119044 | 119061 | GCACATATTTACATTTTA | 94 | 5-8-5 | 1218 |
| 621442 | 119224 | 119241 | GGTGAGAGAGCCAGCCTC | 59 | 5-8-5 | 1219 |
| 621443 | 119404 | 119421 | CAAACAGCCTCCCATGAA | 38 | 5-8-5 | 1220 |
| 621444 | 119584 | 119601 | ATATCCTAAGCATTGTCT | 71 | 5-8-5 | 1221 |
| 621445 | 119880 | 119897 | TACAGTGGCTCCTGTAAT | 18 | 5-8-5 | 1222 |
| 621446 | 120060 | 120077 | GCTCATCAAAGCAAAAAC | 84 | 5-8-5 | 1223 |
| 621447 | 120248 | 120265 | CTGGGCTGTCGGATCTGG | 69 | 5-8-5 | 1224 |
| 621448 | 120439 | 120456 | AAGCCACCATGCCTGTAA | 89 | 5-8-5 | 1225 |
| 621449 | 120660 | 120677 | ACACCATCACGGCTCAGT | 56 | 5-8-5 | 1226 |
| 621450 | 120840 | 120857 | AGGGAGTTGGAAAAACTG | 46 | 5-8-5 | 1227 |
| 621451 | 121209 | 121226 | CAGGTTTGAGAAGCCCTG | 0 | 5-8-5 | 1228 |
| 621452 | 121389 | 121406 | AGACCCACCGGCACATTC | 56 | 5-8-5 | 1229 |
| 621453 | 121569 | 121586 | ATTTCCAGCGGGCTTTAC | 62 | 5-8-5 | 1230 |
| 621454 | 121761 | 121778 | GCTTGCTCGCAAGGACGC | 93 | 5-8-5 | 1231 |
| 621455 | 121941 | 121958 | CCACAGCACGGCGCATGG | 65 | 5-8-5 | 1232 |
| 621456 | 122121 | 122138 | ACACCCCTCCTAGAATA | 0 | 5-8-5 | 1233 |
| 621457 | 122301 | 122318 | ACCACCTTCAGCCCAACT | 22 | 5-8-5 | 1234 |
| 621458 | 122481 | 122498 | TAAGCTGGAGGCTTAGGA | 40 | 5-8-5 | 1235 |
| 621459 | 122678 | 122695 | GAACCTCCCGCCTTAGTC | 19 | 5-8-5 | 1236 |
| 621460 | 122913 | 122930 | TATATGATTGTTTTTTGA | 0 | 5-8-5 | 1237 |
| 621461 | 123093 | 123110 | AGGAGCCTCGGGTGCCCA | 30 | 5-8-5 | 1238 |
| 621462 | 123273 | 123290 | TCAGGCCAGGCATTTTCT | 58 | 5-8-5 | 1239 |
| 621463 | 123453 | 123470 | CACTTAGCAGACACTGGT | 77 | 5-8-5 | 1240 |
| 621464 | 123633 | 123650 | TCCTCTGGCCGAGCTCAC | 58 | 5-8-5 | 1241 |
| 621465 | 123824 | 123841 | ACAGCGCGGGACACACGG | 77 | 5-8-5 | 1242 |
| 621466 | 124004 | 124021 | GCATCTCTTCTCACCAGG | 13 | 5-8-5 | 1243 |
| 621467 | 124184 | 124201 | GGATACCTGGAGGGCAGG | 13 | 5-8-5 | 1244 |
| 621468 | 124379 | 124396 | TGAGGCCAGCACTGAGGG | 29 | 5-8-5 | 1245 |
| 621469 | 124559 | 124576 | ACTGGAACCATCCCGAAT | 37 | 5-8-5 | 1246 |
| 621470 | 124752 | 124769 | GCAGTGGCCTTGTGTGGG | 19 | 5-8-5 | 1247 |
| 621471 | 124932 | 124949 | ACCCTGAGCTGCCAGCTG | 53 | 5-8-5 | 1248 |
| 621472 | 125112 | 125129 | CTGCACACTCAGTGTCCT | 78 | 5-8-5 | 1249 |

TABLE 26-continued

Inhibition of tau mRNA by 5-10-5 and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 621473 | 125292 | 125309 | CTGGAAAGGCAGGAGTGG | 33 | 5-8-5 | 1250 |
| 621474 | 125472 | 125489 | AAGAGCCTCTGGGAAAAA | 50 | 5-8-5 | 1251 |
| 621475 | 125652 | 125669 | GGTGTAACTCAATGAGAA | 41 | 5-8-5 | 1252 |
| 621476 | 125832 | 125849 | GGCTACCTGGTTTATGAT | 32 | 5-8-5 | 1253 |
| 621477 | 126012 | 126029 | GGAGCGAGCTGGAGCCAC | 75 | 5-8-5 | 1254 |
| 621478 | 126332 | 126349 | GCTCACTCCGCTCACTGC | 74 | 5-8-5 | 1255 |
| 621479 | 126527 | 126544 | CTAGGTCTTATTCTATTT | 38 | 5-8-5 | 1256 |
| 621480 | 127208 | 127225 | AGGTTTTGTTGTGTGTT | 54 | 5-8-5 | 1257 |
| 621481 | 127396 | 127413 | CCTCTTCACCTTAAAAAA | 24 | 5-8-5 | 1258 |
| 621482 | 127591 | 127608 | AAACAAAGTCACAGAGGG | 67 | 5-8-5 | 1259 |
| 621483 | 127934 | 127951 | AGGATCACTTTCTTTTCT | 31 | 5-8-5 | 1260 |
| 621484 | 128271 | 128288 | TTGCTGAGTCTCACTCTG | 87 | 5-8-5 | 1261 |
| 621485 | 128451 | 128468 | CAGAATCTATAGCTGTGT | 51 | 5-8-5 | 1262 |
| 621486 | 128631 | 128648 | ATACTTTCCACAGGGAGA | 45 | 5-8-5 | 1263 |
| 621487 | 128811 | 128828 | GAAGAAGGGTCCCTCTCT | 38 | 5-8-5 | 1264 |
| 621488 | 128993 | 129010 | ATGAGAGTACAACTCCAT | 44 | 5-8-5 | 1265 |
| 621489 | 129269 | 129286 | ACCCTTTCAGGCCGGGCG | 44 | 5-8-5 | 1266 |
| 621490 | 129678 | 129695 | TAAGTAAAGTCTGTTTTT | 47 | 5-8-5 | 1267 |
| 621491 | 129861 | 129878 | TAGAATGGTGTTTGGATA | 42 | 5-8-5 | 1268 |
| 621492 | 130040 | 130057 | GCAGTCTACAGGGCAAAG | 79 | 5-8-5 | 1269 |
| 621493 | 130234 | 130251 | ACCTTTTTATTTCCTCCG | 14 | 5-8-5 | 1270 |
| 621494 | 130414 | 130431 | AGCTCCAGGTGATTGAGA | 68 | 5-8-5 | 1271 |
| 621495 | 130691 | 130708 | GTCGCCATGTAAGAAATG | 46 | 5-8-5 | 1272 |
| 621496 | 130902 | 130919 | AGGGAGACTGATATGGTT | 31 | 5-8-5 | 1273 |
| 621497 | 131113 | 131130 | ATATTGCTTGACCTCAGG | 18 | 5-8-5 | 1274 |
| 621498 | 131543 | 131560 | AGTGGTTCTCGCTTTTTT | 75 | 5-8-5 | 1275 |
| 621499 | 131725 | 131742 | CAAGACAGGCAGGCAGAG | 19 | 5-8-5 | 1276 |
| 621500 | 131905 | 131922 | GTGCTTGGCTGCGCTTCT | 45 | 5-8-5 | 1277 |
| 621501 | 132085 | 132102 | CAGACCTCTATCTTTTAG | 24 | 5-8-5 | 1278 |
| 621502 | 132266 | 132283 | AGGAGGGTCTTTCCCGTG | 57 | 5-8-5 | 1279 |
| 621503 | 132446 | 132463 | AACTGGGCCACCATGAGA | 30 | 5-8-5 | 1280 |

TABLE 27

Inhibition of Tau mRNA by 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 621519 | 5901 | 5918 | CCTGCCGCTCGGCCGTCC | 19 | 5-8-5 | 1281 |
| 621520 | 5904 | 5921 | CGCCCTGCCGCTCGGCCG | 0 | 5-8-5 | 1282 |
| 621521 | 5919 | 5936 | GTGGGCGCGCGCGAGCGC | 7 | 5-8-5 | 1283 |
| 621522 | 5922 | 5939 | CTAGTGGGCGCGCGCGAG | 6 | 5-8-5 | 1284 |
| 621523 | 5925 | 5942 | CCACTAGTGGGCGCGCGC | 0 | 5-8-5 | 1285 |
| 621524 | 5928 | 5945 | CGGCCACTAGTGGGCGCG | 18 | 5-8-5 | 1286 |
| 621525 | 5931 | 5948 | CTCCGGCCACTAGTGGGC | 39 | 5-8-5 | 1287 |
| 621526 | 5934 | 5951 | CTCCTCCGGCCACTAGTG | 37 | 5-8-5 | 1288 |
| 621527 | 5937 | 5954 | CTTCTCCTCCGGCCACTA | 15 | 5-8-5 | 1289 |
| 621528 | 5940 | 5957 | AGCCTTCTCCTCCGGCCA | 0 | 5-8-5 | 1290 |
| 621529 | 5943 | 5960 | GGGAGCCTTCTCCTCCGG | 0 | 5-8-5 | 1291 |
| 621530 | 5946 | 5963 | CGCGGGAGCCTTCTCCTC | 28 | 5-8-5 | 1292 |
| 621531 | 5949 | 5966 | CTCCGCGGGAGCCTTCTC | 0 | 5-8-5 | 1293 |
| 621532 | 5952 | 5969 | GGCCTCCGCGGGAGCCTT | 0 | 5-8-5 | 1294 |
| 621533 | 5955 | 5972 | CGCGGCCTCCGCGGGAGC | 0 | 5-8-5 | 1295 |
| 621534 | 5958 | 5975 | CAGCGCGGCCTCCGCGGG | 0 | 5-8-5 | 1296 |
| 621535 | 5961 | 5978 | GGGCAGCGCGGCCTCCGC | 31 | 5-8-5 | 1297 |
| 621536 | 5964 | 5981 | GGCGGGCAGCGCGGCCTC | 17 | 5-8-5 | 1298 |
| 621537 | 5987 | 6004 | ACGCGAGCCTCCCCAGGG | 10 | 5-8-5 | 1299 |
| 621538 | 5990 | 6007 | GGAACGCGAGCCTCCCCA | 33 | 5-8-5 | 1300 |
| 621539 | 5993 | 6010 | GCGGGAACGCGAGCCTCC | 0 | 5-8-5 | 1301 |
| 621540 | 5996 | 6013 | GCAGCGGGAACGCGAGCC | 0 | 5-8-5 | 1302 |
| 621541 | 5999 | 6016 | CGAGCAGCGGGAACGCGA | 0 | 5-8-5 | 1303 |
| 621542 | 6002 | 6019 | GCGCGAGCAGCGGGAACG | 9 | 5-8-5 | 1304 |
| 621543 | 6005 | 6022 | CAGGCGCGAGCAGCGGGA | 22 | 5-8-5 | 1305 |
| 621544 | 6008 | 6025 | GCGCAGGCGCGAGCAGCG | 1 | 5-8-5 | 1306 |
| 621545 | 6011 | 6028 | GCGGCGCAGGCGCGAGCA | 11 | 5-8-5 | 1307 |
| 621546 | 6014 | 6031 | CGGGCGGCGCAGGCGCGA | 47 | 5-8-5 | 1308 |
| 621547 | 6017 | 6034 | CGGCGGGCGGCGCAGGCG | 15 | 5-8-5 | 1309 |
| 621548 | 6020 | 6037 | GGCCGGCGGGCGGCGCAG | 0 | 5-8-5 | 1310 |
| 621549 | 6023 | 6040 | TGAGGCCGGCGGGCGGCG | 5 | 5-8-5 | 1311 |
| 621550 | 6026 | 6043 | TCCTGAGGCCGGCGGGCG | 20 | 5-8-5 | 1312 |
| 621551 | 6029 | 6046 | CGTTCCTGAGGCCGGCGG | 13 | 5-8-5 | 1313 |
| 621552 | 6045 | 6062 | GCCGGCGAAGAGGGCGCG | 0 | 5-8-5 | 1314 |
| 621553 | 6048 | 6065 | CGCGCCGGCGAAGAGGGC | 0 | 5-8-5 | 1315 |
| 621554 | 6051 | 6068 | GCGCGCCGGCGAAGAG | 0 | 5-8-5 | 1316 |
| 621555 | 6054 | 6071 | AGGGCGCGCGCCGGCGAA | 32 | 5-8-5 | 1317 |

TABLE 27-continued

Inhibition of Tau mRNA by 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 621556 | 6057 | 6074 | GCGAGGGCGCGCGCCGGC | 15 | 5-8-5 | 1318 |
| 621557 | 6060 | 6077 | ACTGCGAGGGCGCGCGCC | 30 | 5-8-5 | 1319 |
| 621558 | 6063 | 6080 | GTGACTGCGAGGGCGCGC | 38 | 5-8-5 | 1320 |
| 621559 | 6066 | 6083 | GCGGTGACTGCGAGGGCG | 30 | 5-8-5 | 1321 |
| 621560 | 6069 | 6086 | GTGGCGGTGACTGCGAGG | 37 | 5-8-5 | 1322 |
| 621561 | 6072 | 6089 | TGGGTGGCGGTGACTGCG | 48 | 5-8-5 | 1323 |
| 621562 | 6075 | 6092 | TGGTGGGTGGCGGTGACT | 34 | 5-8-5 | 1324 |
| 621563 | 6078 | 6095 | AGCTGGTGGGTGGCGGTG | 54 | 5-8-5 | 1325 |
| 621564 | 6081 | 6098 | CGGAGCTGGTGGGTGGCG | 36 | 5-8-5 | 1326 |
| 621565 | 6084 | 6101 | TGCCGGAGCTGGTGGGTG | 52 | 5-8-5 | 1327 |
| 621566 | 6087 | 6104 | TGGTGCCGGAGCTGGTGG | 64 | 5-8-5 | 1328 |
| 621567 | 6090 | 6107 | TGTTGGTGCCGGAGCTGG | 74 | 5-8-5 | 1329 |
| 621568 | 6093 | 6110 | TGCTGTTGGTGCCGGAGC | 50 | 5-8-5 | 1330 |
| 621569 | 6096 | 6113 | CGCTGCTGTTGGTGCCGG | 47 | 5-8-5 | 1331 |
| 621570 | 6111 | 6128 | GGGCGGTGGCAGCGGCGC | 86 | 5-8-5 | 1332 |
| 621571 | 6114 | 6131 | GGTGGGCGGTGGCAGCGG | 61 | 5-8-5 | 1333 |
| 621572 | 6117 | 6134 | GAAGGTGGGCGGTGGCAG | 19 | 5-8-5 | 1334 |
| 621573 | 6120 | 6137 | GCAGAAGGTGGGCGGTGG | 22 | 5-8-5 | 1335 |
| 621574 | 6123 | 6140 | GCGGCAGAAGGTGGGCGG | 18 | 5-8-5 | 1336 |
| 621575 | 6126 | 6143 | GCGGCGGCAGAAGGTGGG | 62 | 5-8-5 | 1337 |
| 621576 | 6129 | 6146 | GTGGCGGCGGCAGAAGGT | 79 | 5-8-5 | 1338 |
| 621577 | 6132 | 6149 | GTGGTGGCGGCGGCAGAA | 70 | 5-8-5 | 1339 |
| 621578 | 6135 | 6152 | GCTGTGGTGGCGGCGGCA | 78 | 5-8-5 | 1340 |
| 621579 | 6138 | 6155 | GTGGCTGTGGTGGCGGCG | 78 | 5-8-5 | 1341 |
| 621580 | 6141 | 6158 | AAGGTGGCTGTGGTGGCG | 72 | 5-8-5 | 1342 |
| 613412 | 73879 | 73898 | GTGATCTTCCATCACTTCGA | 78 | 5-8-5 | 25 |
| 620887 | 98891 98928 | 98908 98945 | GTTTTCAAACACACCTTC | 94 | 5-8-5 | 665 |
| 621504 | 132626 | 132643 | AAACCCTTCTCACAAAAC | 17 | 5-8-5 | 1343 |
| 621505 | 132812 | 132829 | CCTCCTGGTCCCTCCTCG | 12 | 5-8-5 | 1344 |
| 621506 | 132992 | 133009 | CCTATCCAGACCCACTCA | 10 | 5-8-5 | 1345 |
| 621507 | 133179 | 133196 | CACAACCACCCCGGGACG | 8 | 5-8-5 | 1346 |
| 621508 | 133359 | 133376 | GGACCAGGATGGTGTTTT | 44 | 5-8-5 | 1347 |
| 621509 | 133539 | 133556 | GGCTTTGATAAAAATATT | 8 | 5-8-5 | 1348 |
| 621510 | 133788 | 133805 | CGCCTCCGGGATCAAGCA | 47 | 5-8-5 | 1349 |
| 621511 | 133968 | 133985 | GGTTCGCATTTAAGCTAG | 28 | 5-8-5 | 1350 |
| 621512 | 134148 | 134165 | ACGGTCATTCTCAGCCCT | 59 | 5-8-5 | 1351 |
| 621513 | 134333 | 134350 | TAACCTCCAGAGCAACTG | 26 | 5-8-5 | 1352 |

TABLE 27-continued

Inhibition of Tau mRNA by 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 621514 | 134513 | 134530 | GGCAGGTGGGCCACAAAA | 17 | 5-8-5 | 1353 |
| 621515 | 134696 | 134713 | TCAAAAGGCATGCACATT | 44 | 5-8-5 | 1354 |
| 621516 | 134876 | 134893 | TAGTATTCCGTCGCCACG | 40 | 5-8-5 | 1355 |
| 621517 | 135057 | 135074 | GAGCTGTTGTTTTTATTG | 7 | 5-8-5 | 1356 |
| 621518 | 135369 | 135386 | GCCAGGGACTGTTTTTTG | 62 | 5-8-5 | 1357 |

TABLE 28

Inhibition of tau mRNA by 5-8-5 MOE gapmers targeting SEQ ID NOs: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 621596 | n/a | n/a | TCACCTGATAGTCGACAG | 70 | 292 | 309 | 5-8-5 | 1358 |
| 621597 | n/a | n/a | AGTTCACCTGATAGTCGA | 61 | 295 | 312 | 5-8-5 | 1359 |
| 621598 | n/a | n/a | CAAAGTTCACCTGATAGT | 44 | 298 | 315 | 5-8-5 | 1360 |
| 621599 | n/a | n/a | GTTCAAAGTTCACCTGAT | 72 | 301 | 318 | 5-8-5 | 1361 |
| 621629 | n/a | n/a | GATTCTTTCAGGCCAGCG | 42 | 442 | 459 | 5-8-5 | 1362 |
| 621630 | n/a | n/a | GGAGATTCTTTCAGGCCA | 0 | 445 | 462 | 5-8-5 | 1363 |
| 621649 | n/a | n/a | ATCTTCCGCTGTTGGAGT | 43 | 527 | 544 | 5-8-5 | 1364 |
| 621650 | n/a | n/a | CACATCTTCCGCTGTTGG | 3 | 530 | 547 | 5-8-5 | 1365 |
| 621651 | n/a | n/a | TGTCACATCTTCCGCTGT | 0 | 533 | 550 | 5-8-5 | 1366 |
| 621652 | n/a | n/a | TGCTGTCACATCTTCCGC | 30 | 536 | 553 | 5-8-5 | 1367 |
| 621653 | n/a | n/a | AGGGTGCTGTCACATCTT | 61 | 540 | 557 | 5-8-5 | 1368 |
| 621581 | 6144 | 6161 | GAGAAGGTGGCTGTGGTG | 14 | 244 | 261 | 5-8-5 | 1369 |
| 621582 | 6147 | 6164 | GAGGAGAAGGTGGCTGTG | 53 | 247 | 264 | 5-8-5 | 1370 |
| 621583 | 6153 | 6170 | GCGGAGGAGGAGAAGGTG | 25 | 253 | 270 | 5-8-5 | 1371 |
| 621584 | 6156 | 6173 | ACAGCGGAGGAGGAGAAG | 2 | 256 | 273 | 5-8-5 | 1372 |
| 621585 | 6159 | 6176 | AGGACAGCGGAGGAGGAG | 38 | 259 | 276 | 5-8-5 | 1373 |
| 621586 | 6162 | 6179 | GAGAGGACAGCGGAGGAG | 53 | 262 | 279 | 5-8-5 | 1374 |
| 621587 | 6165 | 6182 | CGGGAGAGGACAGCGGAG | 43 | 265 | 282 | 5-8-5 | 1375 |
| 621588 | 6168 | 6185 | GGACGGGAGAGGACAGCG | 69 | 268 | 285 | 5-8-5 | 1376 |
| 621589 | 6171 | 6188 | CGAGGACGGGAGAGGACA | 0 | 271 | 288 | 5-8-5 | 1377 |
| 621590 | 6174 | 6191 | AGGCGAGGACGGGAGAGG | 13 | 274 | 291 | 5-8-5 | 1378 |
| 621591 | 6177 | 6194 | CAGAGGCGAGGACGGGAG | 10 | 277 | 294 | 5-8-5 | 1379 |
| 621592 | 6180 | 6197 | CGACAGAGGCGAGGACGG | 57 | 280 | 297 | 5-8-5 | 1380 |
| 621593 | 6183 | 6200 | AGTCGACAGAGGCGAGGA | 61 | 283 | 300 | 5-8-5 | 1381 |
| 621594 | 6186 | 6203 | GATAGTCGACAGAGGCGA | 65 | 286 | 303 | 5-8-5 | 1382 |
| 621595 | 6189 | 6206 | CCTGATAGTCGACAGAGG | 51 | 289 | 306 | 5-8-5 | 1383 |

TABLE 28-continued

Inhibition of tau mRNA by 5-8-5 MOE gapmers targeting SEQ ID NOs: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 621600 | 73838 | 73855 | CTGGTTCAAAGTTCACCT | 52 | 304 | 321 | 5-8-5 | 1384 |
| 621601 | 73841 | 73858 | ATCCTGGTTCAAAGTTCA | 62 | 307 | 324 | 5-8-5 | 1385 |
| 621602 | 73844 | 73861 | GCCATCCTGGTTCAAAGT | 42 | 310 | 327 | 5-8-5 | 1386 |
| 621603 | 73847 | 73864 | TCAGCCATCCTGGTTCAA | 38 | 313 | 330 | 5-8-5 | 1387 |
| 621604 | 73850 | 73867 | GGCTCAGCCATCCTGGTT | 65 | 316 | 333 | 5-8-5 | 1388 |
| 621605 | 73867 | 73884 | CTTCGAACTCCTGGCGGG | 20 | 333 | 350 | 5-8-5 | 1389 |
| 621606 | 73870 | 73887 | TCACTTCGAACTCCTGGC | 51 | 336 | 353 | 5-8-5 | 1390 |
| 621607 | 73873 | 73890 | CCATCACTTCGAACTCCT | 68 | 339 | 356 | 5-8-5 | 1391 |
| 621608 | 73876 | 73893 | CTTCCATCACTTCGAACT | 28 | 342 | 359 | 5-8-5 | 1392 |
| 613412 | 73879 | 73898 | GTGATCTTCCATCACTTCGA | 75 | 345 | 364 | 5-8-5 | 25 |
| 621609 | 73879 | 73896 | GATCTTCCATCACTTCGA | 68 | 345 | 362 | 5-8-5 | 1393 |
| 621610 | 73882 | 73899 | CGTGATCTTCCATCACTT | 13 | 348 | 365 | 5-8-5 | 1394 |
| 621611 | 73906 | 73923 | TGTCCCCCAACCCGTACG | 46 | 372 | 389 | 5-8-5 | 1395 |
| 621612 | 73909 | 73926 | TCCTGTCCCCCAACCCGT | 54 | 375 | 392 | 5-8-5 | 1396 |
| 621613 | 73912 | 73929 | CTTTCCTGTCCCCCAACC | 43 | 378 | 395 | 5-8-5 | 1397 |
| 621614 | 73915 | 73932 | GATCTTTCCTGTCCCCCA | 71 | 381 | 398 | 5-8-5 | 1398 |
| 621615 | 73918 | 73935 | CCTGATCTTTCCTGTCCC | 71 | 384 | 401 | 5-8-5 | 1399 |
| 621616 | 73921 | 73938 | CCCCCTGATCTTTCCTGT | 54 | 387 | 404 | 5-8-5 | 1400 |
| 621617 | 73924 | 73941 | AGCCCCCTGATCTTTCC | 40 | 390 | 407 | 5-8-5 | 1401 |
| 621618 | 73927 | 73944 | TGTAGCCCCCTGATCTT | 35 | 393 | 410 | 5-8-5 | 1402 |
| 621619 | 73930 | 73947 | TGGTGTAGCCCCCTGAT | 31 | 396 | 413 | 5-8-5 | 1403 |
| 621620 | 73933 | 73950 | GCATGGTGTAGCCCCCT | 71 | 399 | 416 | 5-8-5 | 1404 |
| 621621 | 73936 | 73953 | GGTGCATGGTGTAGCCCC | 62 | 402 | 419 | 5-8-5 | 1405 |
| 621622 | 73939 | 73956 | CTTGGTGCATGGTGTAGC | 54 | 405 | 422 | 5-8-5 | 1406 |
| 621623 | 73942 | 73959 | GGTCTTGGTGCATGGTGT | 65 | 408 | 425 | 5-8-5 | 1407 |
| 621624 | 73945 | 73962 | CTTGGTCTTGGTGCATGG | 63 | 411 | 428 | 5-8-5 | 1408 |
| 621625 | 73948 | 73965 | CCTCTTGGTCTTGGTGCA | 49 | 414 | 431 | 5-8-5 | 1409 |
| 621626 | 73951 | 73968 | CACCCTCTTGGTCTTGGT | 65 | 417 | 434 | 5-8-5 | 1410 |
| 621627 | 73956 | 73973 | CGTGTCACCCTCTTGGTC | 49 | 422 | 439 | 5-8-5 | 1411 |
| 621628 | 73959 | 73976 | GTCCGTGTCACCCTCTTG | 70 | 425 | 442 | 5-8-5 | 1412 |
| 621631 | 83395 | 83412 | AGATCCGTCCTCAGTGGG | 48 | 473 | 490 | 5-8-5 | 1413 |
| 621632 | 83398 | 83415 | CTCAGATCCGTCCTCAGT | 38 | 476 | 493 | 5-8-5 | 1414 |
| 621633 | 83401 | 83418 | TTCCTCAGATCCGTCCTC | 11 | 479 | 496 | 5-8-5 | 1415 |
| 621634 | 83404 | 83421 | CGGTTCCTCAGATCCGTC | 57 | 482 | 499 | 5-8-5 | 1416 |
| 621635 | 83407 | 83424 | GCCCGGTTCCTCAGATCC | 38 | 485 | 502 | 5-8-5 | 1417 |
| 621636 | 83410 | 83427 | AGAGCCCGGTTCCTCAGA | 63 | 488 | 505 | 5-8-5 | 1418 |

TABLE 28-continued

Inhibition of tau mRNA by 5-8-5 MOE gapmers targeting SEQ ID NOs: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 621637 | 83413 | 83430 | TTCAGAGCCCGGTTCCTC | 50 | 491 | 508 | 5-8-5 | 1419 |
| 621638 | 83416 | 83433 | GGTTTCAGAGCCCGGTTC | 48 | 494 | 511 | 5-8-5 | 1420 |
| 621639 | 83419 | 83436 | AGAGGTTTCAGAGCCCGG | 41 | 497 | 514 | 5-8-5 | 1421 |
| 621640 | 83422 | 83439 | ATCAGAGGTTTCAGAGCC | 40 | 500 | 517 | 5-8-5 | 1422 |
| 621641 | 83425 | 83442 | AGCATCAGAGGTTTCAGA | 23 | 503 | 520 | 5-8-5 | 1423 |
| 621642 | 83428 | 83445 | CTTAGCATCAGAGGTTTC | 50 | 506 | 523 | 5-8-5 | 1424 |
| 621643 | 83431 | 83448 | GCTCTTAGCATCAGAGGT | 69 | 509 | 526 | 5-8-5 | 1425 |
| 621644 | 83434 | 83451 | AGTGCTCTTAGCATCAGA | 80 | 512 | 529 | 5-8-5 | 1426 |
| 621645 | 83437 | 83454 | TGGAGTGCTCTTAGCATC | 50 | 515 | 532 | 5-8-5 | 1427 |
| 621646 | 83440 | 83457 | TGTTGGAGTGCTCTTAGC | 59 | 518 | 535 | 5-8-5 | 1428 |
| 621647 | 83443 | 83460 | CGCTGTTGGAGTGCTCTT | 70 | 521 | 538 | 5-8-5 | 1429 |
| 621648 | 83446 | 83463 | TTCCGCTGTTGGAGTGCT | 52 | 524 | 541 | 5-8-5 | 1430 |
| 621654 | 85904 | 85921 | CTAAGGGTGCTGTCACAT | 64 | 543 | 560 | 5-8-5 | 1431 |
| 621655 | 85907 | 85924 | CCACTAAGGGTGCTGTCA | 44 | 546 | 563 | 5-8-5 | 1432 |
| 621656 | 85910 | 85927 | CATCCACTAAGGGTGCTG | 55 | 549 | 566 | 5-8-5 | 1433 |
| 621657 | 85913 | 85930 | CCTCATCCACTAAGGGTG | 41 | 552 | 569 | 5-8-5 | 1434 |
| 620887 | 98891 98928 | 98908 98945 | GTTTTCAAACACACCTTC | 81 | n/a n/a | n/a n/a | 5-8-5 | 665 |

TABLE 29

Inhibition of Tau mRNA by 5-8-5 MOE gapmers targeting SEQ ID NOs: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO |
|---|---|---|---|---|---|---|---|---|
| 621672 | n/a | n/a | GCTGTGGTTCCTTCTGGG | 51 | 613 | 630 | 5-8-5 | 1435 |
| 621676 | n/a | n/a | TCAGGCTCTTGGGTCACG | 0 | 685 | 702 | 5-8-5 | 1436 |
| 621677 | n/a | n/a | CTTTCAGGCTCTTGGGTC | 0 | 688 | 705 | 5-8-5 | 1437 |
| 621678 | n/a | n/a | CCACTTTCAGGCTCTTGG | 51 | 691 | 708 | 5-8-5 | 1438 |
| 613412 | 73879 | 73898 | GTGATCTTCCATCACTTCGA | 79 | 345 | 364 | 5-10-5 | 25 |
| 621658 | 85916 | 85933 | CTCCCTCATCCACTAAGG | 27 | 555 | 572 | 5-8-5 | 1439 |
| 621659 | 85919 | 85936 | GAGCTCCCTCATCCACTA | 35 | 558 | 575 | 5-8-5 | 1440 |
| 621660 | 85922 | 85939 | CGGGAGCTCCCTCATCCA | 25 | 561 | 578 | 5-8-5 | 1441 |
| 621661 | 85925 | 85942 | TGCCGGGAGCTCCCTCAT | 40 | 564 | 581 | 5-8-5 | 1442 |
| 621662 | 85928 | 85945 | GCTTGCCGGGAGCTCCCT | 47 | 567 | 584 | 5-8-5 | 1443 |
| 621663 | 85931 | 85948 | CCTGCTTGCCGGGAGCTC | 46 | 570 | 587 | 5-8-5 | 1444 |
| 621664 | 85934 | 85951 | CAGCCTGCTTGCCGGGAG | 45 | 573 | 590 | 5-8-5 | 1445 |
| 621665 | 85937 | 85954 | CGGCAGCCTGCTTGCCGG | 1 | 576 | 593 | 5-8-5 | 1446 |
| 621666 | 85940 | 85957 | GCGCGGCAGCCTGCTTGC | 31 | 579 | 596 | 5-8-5 | 1447 |

TABLE 29-continued

Inhibition of Tau mRNA by 5-8-5 MOE gapmers targeting SEQ ID NOs: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO |
|---|---|---|---|---|---|---|---|---|
| 621667 | 85943 | 85960 | GCTGCGCGGCAGCCTGCT | 50 | 582 | 599 | 5-8-5 | 1448 |
| 621668 | 85962 | 85979 | TCTGGGATCTCCGTGTGG | 39 | 601 | 618 | 5-8-5 | 1449 |
| 621669 | 85965 | 85982 | CCTTCTGGGATCTCCGTG | 56 | 604 | 621 | 5-8-5 | 1450 |
| 621670 | 85968 | 85985 | GTTCCTTCTGGGATCTCC | 79 | 607 | 624 | 5-8-5 | 1451 |
| 621671 | 85971 | 85988 | GTGGTTCCTTCTGGGATC | 49 | 610 | 627 | 5-8-5 | 1452 |
| 621673 | 89894 | 89911 | CAATGCCTGCTTCTTCAG | 31 | 630 | 647 | 5-8-5 | 1453 |
| 621674 | 89899 | 89916 | GTCTCCAATGCCTGCTTC | 43 | 635 | 652 | 5-8-5 | 1454 |
| 621675 | 89902 | 89919 | GGTGTCTCCAATGCCTGC | 74 | 638 | 655 | 5-8-5 | 1455 |
| 621679 | 94695 | 94712 | TTACCACTTTCAGGCTCT | 63 | 694 | 711 | 5-8-5 | 1456 |
| 621680 | 94700 | 94717 | CCACCTTACCACTTTCAG | 28 | 699 | 716 | 5-8-5 | 1457 |
| 621681 | 94703 | 94720 | GGACCACCTTACCACTTT | 62 | 702 | 719 | 5-8-5 | 1458 |
| 621682 | 94706 | 94723 | CCTGGACCACCTTACCAC | 33 | 705 | 722 | 5-8-5 | 1459 |
| 621683 | 94709 | 94726 | CTTCCTGGACCACCTTAC | 18 | 708 | 725 | 5-8-5 | 1460 |
| 621684 | 94712 | 94729 | AGCCTTCCTGGACCACCT | 61 | 711 | 728 | 5-8-5 | 1461 |
| 621685 | 94715 | 94732 | GGAAGCCTTCCTGGACCA | 54 | 714 | 731 | 5-8-5 | 1462 |
| 621686 | 94718 | 94735 | GGAGGAAGCCTTCCTGGA | 24 | 717 | 734 | 5-8-5 | 1463 |
| 621687 | 94721 | 94738 | CTCGGAGGAAGCCTTCCT | 48 | 720 | 737 | 5-8-5 | 1464 |
| 621688 | 94724 | 94741 | GCTCTCGGAGGAAGCCTT | 27 | 723 | 740 | 5-8-5 | 1465 |
| 621689 | 94727 | 94744 | CTGGCTCTCGGAGGAAGC | 19 | 726 | 743 | 5-8-5 | 1466 |
| 621690 | 94730 | 94747 | GGCCTGGCTCTCGGAGGA | 46 | 729 | 746 | 5-8-5 | 1467 |
| 621691 | 94749 | 94766 | TGGTGGCTCAGACCTGGG | 49 | 748 | 765 | 5-8-5 | 1468 |
| 621692 | 94752 | 94769 | AGCTGGTGGCTCAGACCT | 50 | 751 | 768 | 5-8-5 | 1469 |
| 621693 | 94755 | 94772 | ATGAGCTGGTGGCTCAGA | 17 | 754 | 771 | 5-8-5 | 1470 |
| 621694 | 94758 | 94775 | GACATGAGCTGGTGGCTC | 54 | 757 | 774 | 5-8-5 | 1471 |
| 621695 | 94761 | 94778 | CCGGACATGAGCTGGTGG | 26 | 760 | 777 | 5-8-5 | 1472 |
| 621696 | 94764 | 94781 | ATGCCGGACATGAGCTGG | 12 | 763 | 780 | 5-8-5 | 1473 |
| 621697 | 94767 | 94784 | GGCATGCCGGACATGAGC | 11 | 766 | 783 | 5-8-5 | 1474 |
| 621698 | 94770 | 94787 | CCAGGCATGCCGGACATG | 41 | 769 | 786 | 5-8-5 | 1475 |
| 621699 | 94773 | 94790 | GCCCAGGCATGCCGGAC | 57 | 772 | 789 | 5-8-5 | 1476 |
| 621700 | 94776 | 94793 | GGAGCCCAGGCATGCCG | 47 | 775 | 792 | 5-8-5 | 1477 |
| 621701 | 94793 | 94810 | GGCCCTCAGGCAGGAGGG | 0 | 792 | 809 | 5-8-5 | 1478 |
| 621702 | 94825 | 94842 | TGTCCCCGAAGGTTGGCG | 50 | 824 | 841 | 5-8-5 | 1479 |
| 621703 | 94828 | 94845 | TCCTGTCCCCGAAGGTTG | 38 | 827 | 844 | 5-8-5 | 1480 |
| 621704 | 94831 | 94848 | AGGTCCTGTCCCCGAAGG | 41 | 830 | 847 | 5-8-5 | 1481 |
| 621705 | 94834 | 94851 | CTCAGGTCCTGTCCCCGA | 60 | 833 | 850 | 5-8-5 | 1482 |
| 621706 | 94837 | 94854 | GTCCTCAGGTCCTGTCCC | 0 | 836 | 853 | 5-8-5 | 1483 |
| 621707 | 94840 | 94857 | TGTGTCCTCAGGTCCTGT | 23 | 839 | 856 | 5-8-5 | 1484 |

TABLE 29-continued

Inhibition of Tau mRNA by 5-8-5 MOE gapmers targeting SEQ ID NOs: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO |
|---|---|---|---|---|---|---|---|---|
| 621708 | 94843 | 94860 | CTCTGTGTCCTCAGGTCC | 55 | 842 | 859 | 5-8-5 | 1485 |
| 621709 | 94846 | 94863 | GCCCTCTGTGTCCTCAGG | 35 | 845 | 862 | 5-8-5 | 1486 |
| 621710 | 94849 | 94866 | GCCGCCCTCTGTGTCCTC | 45 | 848 | 865 | 5-8-5 | 1487 |
| 621711 | 94852 | 94869 | GCGGCCGCCCTCTGTGTC | 0 | 851 | 868 | 5-8-5 | 1488 |
| 621712 | 94855 | 94872 | GTGGCGGCCGCCCTCTGT | 0 | 854 | 871 | 5-8-5 | 1489 |
| 621713 | 94875 | 94892 | TGCTTGAGCAGCTCAGGG | 67 | 874 | 891 | 5-8-5 | 1490 |
| 621714 | 94878 | 94895 | TGGTGCTTGAGCAGCTCA | 51 | 877 | 894 | 5-8-5 | 1491 |
| 621715 | 94882 | 94899 | AAGCTGGTGCTTGAGCAG | 27 | 881 | 898 | 5-8-5 | 1492 |
| 621716 | 94885 | 94902 | TAGAAGCTGGTGCTTGAG | 14 | 884 | 901 | 5-8-5 | 1493 |
| 621717 | 94888 | 94905 | TCCTAGAAGCTGGTGCTT | 0 | 887 | 904 | 5-8-5 | 1494 |
| 621718 | 94891 | 94908 | GTCTCCTAGAAGCTGGTG | 45 | 890 | 907 | 5-8-5 | 1495 |
| 621719 | 94894 | 94911 | CAGGTCTCCTAGAAGCTG | 47 | 893 | 910 | 5-8-5 | 1496 |
| 621720 | 94897 | 94914 | GTGCAGGTCTCCTAGAAG | 41 | 896 | 913 | 5-8-5 | 1497 |
| 621721 | 94900 | 94917 | CTGGTGCAGGTCTCCTAG | 36 | 899 | 916 | 5-8-5 | 1498 |
| 621722 | 94903 | 94920 | CTCCTGGTGCAGGTCTCC | 41 | 902 | 919 | 5-8-5 | 1499 |
| 621723 | 94906 | 94923 | CCCCTCCTGGTGCAGGTC | 39 | 905 | 922 | 5-8-5 | 1500 |
| 621724 | 94909 | 94926 | CGGCCCCTCCTGGTGCAG | 19 | 908 | 925 | 5-8-5 | 1501 |
| 621725 | 94912 | 94929 | CGGCGGCCCCTCCTGGTG | 22 | 911 | 928 | 5-8-5 | 1502 |
| 621726 | 94915 | 94932 | CAGCGGCGGCCCCTCCTG | 35 | 914 | 931 | 5-8-5 | 1503 |
| 621727 | 94918 | 94935 | CTTCAGCGGCGGCCCCTC | 46 | 917 | 934 | 5-8-5 | 1504 |
| 621728 | 94921 | 94938 | CCCCTTCAGCGGCGGCCC | 36 | 920 | 937 | 5-8-5 | 1505 |
| 621729 | 94924 | 94941 | TGCCCCCTTCAGCGGCGG | 17 | 923 | 940 | 5-8-5 | 1506 |
| 621730 | 94927 | 94944 | CCCTGCCCCCTTCAGCGG | 15 | 926 | 943 | 5-8-5 | 1507 |
| 621731 | 94930 | 94947 | GCCCCCTGCCCCCTTCAG | 27 | 929 | 946 | 5-8-5 | 1508 |
| 621732 | 94933 | 94950 | TTTGCCCCCTGCCCCCTT | 49 | 932 | 949 | 5-8-5 | 1509 |
| 621733 | 94936 | 94953 | CTCTTTGCCCCCTGCCCC | 22 | 935 | 952 | 5-8-5 | 1510 |
| 621734 | 94939 | 94956 | CCTCTCTTTGCCCCCTGC | 28 | 938 | 955 | 5-8-5 | 1511 |
| 620887 | 98891 98928 | 98908 98945 | GTTTTCAAACACACCTTC | 90 | n/a n/a | n/a n/a | 5-8-5 | 665 |

TABLE 30

Inhibition of tau mRNA by 5-10-5 MOE and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 613412 | 73879 | 73898 | GTGATCTTCCATCACTTCGA | 82 | 5-10-5 | 25 |
| 620887 | 98891 98928 | 98908 98945 | GTTTTCAAACACACCTTC | 92 | 5-8-5 | 665 |

TABLE 30-continued

Inhibition of tau mRNA by 5-10-5 MOE and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 621735 | 94942 | 94959 | CGGCCTCTCTTTGCCCCC | 34 | 5-8-5 | 1512 |
| 621736 | 94945 | 94962 | CCCCGGCCTCTCTTTGCC | 27 | 5-8-5 | 1513 |
| 621737 | 94948 | 94965 | GCTCCCCGGCCTCTCTTT | 44 | 5-8-5 | 1514 |
| 621738 | 94951 | 94968 | CTTGCTCCCCGGCCTCTC | 38 | 5-8-5 | 1515 |
| 621739 | 94954 | 94971 | CTCCTTGCTCCCCGGCCT | 37 | 5-8-5 | 1516 |
| 621740 | 94957 | 94974 | CTCCTCCTTGCTCCCCGG | 33 | 5-8-5 | 1517 |
| 621741 | 94960 | 94977 | CACCTCCTCCTTGCTCCC | 37 | 5-8-5 | 1518 |
| 621742 | 94963 | 94980 | ATCCACCTCCTCCTTGCT | 32 | 5-8-5 | 1519 |
| 621743 | 94967 | 94984 | CTTCATCCACCTCCTCCT | 51 | 5-8-5 | 1520 |
| 621744 | 94970 | 94987 | GGTCTTCATCCACCTCCT | 61 | 5-8-5 | 1521 |
| 621745 | 94973 | 94990 | CGCGGTCTTCATCCACCT | 71 | 5-8-5 | 1522 |
| 621746 | 94976 | 94993 | CGTCGCGGTCTTCATCCA | 48 | 5-8-5 | 1523 |
| 621747 | 95038 | 95055 | CCGCCCATCTTGGGCTGG | 12 | 5-8-5 | 1524 |
| 621748 | 95041 | 95058 | AGGCCGCCCATCTTGGGC | 18 | 5-8-5 | 1525 |
| 621749 | 95044 | 95061 | GGGAGGCCGCCCATCTTG | 21 | 5-8-5 | 1526 |
| 621750 | 95060 | 95077 | CTCTGGCGGCTGTCTGGG | 47 | 5-8-5 | 1527 |
| 621751 | 95063 | 95080 | CTTCTCTGGCGGCTGTCT | 41 | 5-8-5 | 1528 |
| 621752 | 95066 | 95083 | TGGCTTCTCTGGCGGCTG | 53 | 5-8-5 | 1529 |
| 621753 | 95069 | 95086 | TGGTGGCTTCTCTGGCGG | 26 | 5-8-5 | 1530 |
| 621754 | 95072 | 95089 | TGCTGGTGGCTTCTCTGG | 57 | 5-8-5 | 1531 |
| 621755 | 95075 | 95092 | GGATGCTGGTGGCTTCTC | 65 | 5-8-5 | 1532 |
| 621756 | 95078 | 95095 | CTGGGATGCTGGTGGCTT | 66 | 5-8-5 | 1533 |
| 621757 | 95081 | 95098 | AGCCTGGGATGCTGGTGG | 51 | 5-8-5 | 1534 |
| 621758 | 95084 | 95101 | GGAAGCCTGGGATGCTGG | 57 | 5-8-5 | 1535 |
| 621759 | 95092 | 95109 | CTCCGCTGGGAAGCCTGG | 48 | 5-8-5 | 1536 |
| 621760 | 95095 | 95112 | ACCCTCCGCTGGGAAGCC | 38 | 5-8-5 | 1537 |
| 621761 | 95098 | 95115 | GGCACCCTCCGCTGGGAA | 54 | 5-8-5 | 1538 |
| 621762 | 95101 | 95118 | GATGGCACCCTCCGCTGG | 27 | 5-8-5 | 1539 |
| 621763 | 95121 | 95138 | AGGAAATCCACAGGGAGG | 15 | 5-8-5 | 1540 |
| 621764 | 95124 | 95141 | GAGAGGAAATCCACAGGG | 29 | 5-8-5 | 1541 |
| 621765 | 95127 | 95144 | TTGGAGAGGAAATCCACA | 45 | 5-8-5 | 1542 |
| 621766 | 95130 | 95147 | ACTTTGGAGAGGAAATCC | 38 | 5-8-5 | 1543 |
| 621767 | 95134 | 95151 | GGAAACTTTGGAGAGGAA | 56 | 5-8-5 | 1544 |
| 621768 | 95137 | 95154 | TGTGGAAACTTTGGAGAG | 26 | 5-8-5 | 1545 |
| 621769 | 95140 | 95157 | CTCTGTGGAAACTTTGGA | 69 | 5-8-5 | 1546 |
| 621770 | 95143 | 95160 | GATCTCTGTGGAAACTTT | 62 | 5-8-5 | 1547 |

TABLE 30-continued

Inhibition of tau mRNA by 5-10-5 MOE and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 621771 | 95146 | 95163 | TGGGATCTCTGTGGAAAC | 61 | 5-8-5 | 1548 |
| 621772 | 95149 | 95166 | GGCTGGGATCTCTGTGGA | 47 | 5-8-5 | 1549 |
| 621773 | 95152 | 95169 | TGAGGCTGGGATCTCTGT | 32 | 5-8-5 | 1550 |
| 621774 | 95155 | 95172 | CTCTGAGGCTGGGATCTC | 64 | 5-8-5 | 1551 |
| 621775 | 95161 | 95178 | GTCGGGCTCTGAGGCTGG | 42 | 5-8-5 | 1552 |
| 621776 | 95164 | 95181 | CCCGTCGGGCTCTGAGGC | 34 | 5-8-5 | 1553 |
| 621777 | 95174 | 95191 | CTACACTGGGCCCGTCGG | 31 | 5-8-5 | 1554 |
| 621778 | 95177 | 95194 | GCCCTACACTGGGCCCGT | 48 | 5-8-5 | 1555 |
| 621779 | 95180 | 95197 | CCCGCCCTACACTGGGCC | 35 | 5-8-5 | 1556 |
| 621780 | 95183 | 95200 | TGGCCCGCCCTACACTGG | 51 | 5-8-5 | 1557 |
| 621781 | 95186 | 95203 | CTTTGGCCCGCCCTACAC | 4 | 5-8-5 | 1558 |
| 621782 | 95189 | 95206 | GCCCTTTGGCCCGCCCTA | 52 | 5-8-5 | 1559 |
| 621783 | 95192 | 95209 | CCTGCCCTTTGGCCCGCC | 42 | 5-8-5 | 1560 |
| 621784 | 95195 | 95212 | CATCCTGCCCTTTGGCCC | 49 | 5-8-5 | 1561 |
| 621785 | 95198 | 95215 | GGGCATCCTGCCCTTTGG | 15 | 5-8-5 | 1562 |
| 621786 | 95235 | 95252 | TTGGGTGTGATTTCCACG | 52 | 5-8-5 | 1563 |
| 621787 | 95253 | 95270 | GCCTGCTCCTTCTGCACG | 44 | 5-8-5 | 1564 |
| 621788 | 95256 | 95273 | TGCGCCTGCTCCTTCTGC | 64 | 5-8-5 | 1565 |
| 621789 | 95259 | 95276 | GAGTGCGCCTGCTCCTTC | 70 | 5-8-5 | 1566 |
| 621790 | 95262 | 95279 | TCCGAGTGCGCCTGCTCC | 53 | 5-8-5 | 1567 |
| 621791 | 95265 | 95282 | TCCTCCGAGTGCGCCTGC | 54 | 5-8-5 | 1568 |
| 621792 | 95268 | 95285 | TGCTCCTCCGAGTGCGCC | 52 | 5-8-5 | 1569 |
| 621793 | 95271 | 95288 | AAATGCTCCTCCGAGTGC | 72 | 5-8-5 | 1570 |
| 621794 | 95274 | 95291 | CCCAAATGCTCCTCCGAG | 75 | 5-8-5 | 1571 |
| 621795 | 95277 | 95294 | CTTCCCAAATGCTCCTCC | 47 | 5-8-5 | 1572 |
| 621796 | 95280 | 95297 | GCCCTTCCCAAATGCTCC | 58 | 5-8-5 | 1573 |
| 621797 | 95283 | 95300 | GCAGCCCTTCCCAAATGC | 39 | 5-8-5 | 1574 |
| 621798 | 95286 | 95303 | AATGCAGCCCTTCCCAAA | 61 | 5-8-5 | 1575 |
| 621799 | 95291 | 95308 | CTGGAAATGCAGCCCTTC | 64 | 5-8-5 | 1576 |
| 621800 | 95294 | 95311 | CCCCTGGAAATGCAGCCC | 49 | 5-8-5 | 1577 |
| 621801 | 95297 | 95314 | GGGCCCCTGGAAATGCAG | 29 | 5-8-5 | 1578 |
| 621802 | 95313 | 95330 | TCTGGCCCCTCTCCAGGG | 41 | 5-8-5 | 1579 |
| 621803 | 95316 | 95333 | GCCTCTGGCCCCTCTCCA | 42 | 5-8-5 | 1580 |
| 621804 | 95319 | 95336 | CGGGCCTCTGGCCCCTCT | 11 | 5-8-5 | 1581 |
| 621805 | 95322 | 95339 | CCCCGGGCCTCTGGCCCC | 13 | 5-8-5 | 1582 |
| 621806 | 95341 | 95358 | GTCCTCTCCCAAAGAGGG | 25 | 5-8-5 | 1583 |
| 621807 | 95344 | 95361 | TGTGTCCTCTCCCAAAGA | 20 | 5-8-5 | 1584 |

TABLE 30-continued

Inhibition of tau mRNA by 5-10-5 MOE and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 621808 | 95347 | 95364 | TTTTGTGTCCTCTCCCAA | 66 | 5-8-5 | 1585 |
| 621809 | 95365 | 95382 | CTCTGGAAGGTCAGCCTC | 53 | 5-8-5 | 1586 |
| 621810 | 95368 | 95385 | GGGCTCTGGAAGGTCAGC | 72 | 5-8-5 | 1587 |
| 621811 | 95371 | 95388 | AGAGGGCTCTGGAAGGTC | 57 | 5-8-5 | 1588 |

TABLE 31

Inhibition of tau mRNA by 5-10-5 and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 613412 | 73879 | 73898 | GTGATCTTCCATCACTTCGA | 88 | 5-10-5 | 25 |
| 620887 | 98891 98928 | 98908 98945 | GTTTTCAAACACACCTTC | 96 | 5-8-5 | 665 |
| 623737 | 111219 | 111236 | CCTCCACCCAGCATGGTG | 56 | 5-8-5 | 1589 |
| 623738 | 111267 | 111284 | TCAAGTCACCCTTTCTCC | 78 | 5-8-5 | 1590 |
| 623739 | 111368 | 111385 | TTCAGACAATTTTTCTAG | 66 | 5-8-5 | 1591 |
| 623740 | 111629 | 111646 | TCAGACTCCGCCAGCTTT | 79 | 5-8-5 | 1592 |
| 623741 | 111678 | 111695 | TCTTTTCCCTTTGGTGTT | 34 | 5-8-5 | 1593 |
| 623742 | 111753 | 111770 | TTTCCCCCAATGATTTGC | 77 | 5-8-5 | 1594 |
| 623743 | 112016 | 112033 | CCACGACTCCCACAAGAT | 32 | 5-8-5 | 1595 |
| 623744 | 112213 | 112230 | TGAGGTTGAGGGTAGGTG | 50 | 5-8-5 | 1596 |
| 623745 | 112219 | 112236 | AGTGGTTGAGGTTGAGGG | 31 | 5-8-5 | 1597 |
| 623746 | 112304 | 112321 | CAGGCACTTGGAAACTGC | 90 | 5-8-5 | 1598 |
| 623747 | 112877 | 112894 | TTGTACTCTTTTTCCCCT | 65 | 5-8-5 | 1599 |
| 623748 | 112949 | 112966 | TTAGGAGTGCAAGGTTGT | 49 | 5-8-5 | 1600 |
| 623749 | 113352 | 113369 | TCCTACATTCCTCCTGCT | 67 | 5-8-5 | 1601 |
| 623750 | 113523 | 113540 | GTTGCAGTGTTCCACTAT | 90 | 5-8-5 | 1602 |
| 623751 | 113783 | 113800 | CCAGCAGATGCCGACAGC | 74 | 5-8-5 | 1603 |
| 623752 | 113809 | 113826 | GGGCCCTCACCCCTGCTT | 14 | 5-8-5 | 1604 |
| 623753 | 113830 | 113847 | CCAAGAAGGGCTGCTGAG | 8 | 5-8-5 | 1605 |
| 623754 | 114267 | 114284 | AAGCAGCCACCCAGGCTG | 17 | 5-8-5 | 1606 |
| 623755 | 114739 | 114756 | TATGAGGAGGGAGGAAAG | 13 | 5-8-5 | 1607 |
| 623756 | 115242 | 115259 | CTGACATCTCAGCCCAAG | 93 | 5-8-5 | 1608 |
| 621425 | 115335 | 115352 | GGTACAGGAAAAGATGCC | 77 | 5-8-5 | 1202 |
| 623757 | 115522 | 115539 | CAAGGTGATCAGCTTAGG | 82 | 5-8-5 | 1609 |
| 623758 | 115526 | 115543 | AGTCCAAGGTGATCAGCT | 89 | 5-8-5 | 1610 |
| 623759 | 115547 | 115564 | CCCACACAAGCCTCCTCT | 66 | 5-8-5 | 1611 |

TABLE 31-continued

Inhibition of tau mRNA by 5-10-5 and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 623760 | 115791 | 115808 | TTTGTTTGGGTTCAGTTC | 59 | 5-8-5 | 1612 |
| 623761 | 115803 | 115820 | CCTTGATCTGGTTTGTT | 77 | 5-8-5 | 1613 |
| 623762 | 115993 | 116010 | ATCAAGGGAGAGAACGAT | 52 | 5-8-5 | 1614 |
| 623763 | 116229 | 116246 | AAAAGGCAACAAGCCTTT | 0 | 5-8-5 | 1615 |
| 623764 | 116769 | 116786 | CGAGGCAAAAGGGAAAT | 45 | 5-8-5 | 1616 |
| 623765 | 116791 | 116808 | TAACTTTGAGCTTCCTGG | 65 | 5-8-5 | 1617 |
| 623766 | 116944 | 116961 | TAAGGCTTAGAAGATTTG | 45 | 5-8-5 | 1618 |
| 623767 | 116978 | 116995 | GACGATCATTTTTATTC | 72 | 5-8-5 | 1619 |
| 623768 | 116983 | 117000 | GGCTTGACGATCATTTTT | 77 | 5-8-5 | 1620 |
| 623769 | 117421 | 117438 | AGATCTCAGAGTTTGTAG | 68 | 5-8-5 | 1621 |
| 623770 | 117472 | 117489 | TCGCTGAGGTTCCGCAAC | 37 | 5-8-5 | 1622 |
| 623771 | 117489 | 117506 | AGGAGGCCATGTGAGGCT | 61 | 5-8-5 | 1623 |
| 623772 | 117547 | 117564 | TGGATAAATCTCTAGTGC | 54 | 5-8-5 | 1624 |
| 623773 | 117564 | 117581 | CACTCCTCCTTTAGAGAT | 38 | 5-8-5 | 1625 |
| 623774 | 117599 | 117616 | TTGTAATTCCTTCTCTGG | 65 | 5-8-5 | 1626 |
| 623775 | 117971 | 117988 | TAACCATCCCTACTTTCT | 42 | 5-8-5 | 1627 |
| 623776 | 119098 | 119115 | ACTGAAATCGCTCCTTTA | 58 | 5-8-5 | 1628 |
| 623777 | 119107 | 119124 | CCAATTATGACTGAAATC | 32 | 5-8-5 | 1629 |
| 623778 | 119313 | 119330 | GGTCAAAGTTATAAATAT | 57 | 5-8-5 | 1630 |
| 623779 | 119431 | 119448 | GGATTTGATGCAAAGAAA | 70 | 5-8-5 | 1631 |
| 623780 | 119740 | 119757 | GCGCAACCCAGCTACTCG | 7 | 5-8-5 | 1632 |
| 621445 | 119880 | 119897 | TACAGTGGCTCCTGTAAT | 28 | 5-8-5 | 1222 |
| 623781 | 119964 | 119981 | CTGTATACCTATACTTGG | 34 | 5-8-5 | 1633 |
| 623782 | 120043 | 120060 | CCGTTTCTTACCACCCT | 92 | 5-8-5 | 1634 |
| 623783 | 120177 | 120194 | TTACTTGTCTGAATCTTC | 83 | 5-8-5 | 1635 |
| 623784 | 120204 | 120221 | TTCATCCCGTTTTTTTC | 54 | 5-8-5 | 1636 |
| 623785 | 120309 | 120326 | GACCTCAGTGGCTCTTTT | 68 | 5-8-5 | 1637 |
| 623786 | 120513 | 120530 | TGTCCAGGATAGTTTGAA | 44 | 5-8-5 | 1638 |
| 623787 | 121033 | 121050 | GCTGAGCAAATGCTCCCG | 54 | 5-8-5 | 1639 |
| 623788 | 121194 | 121211 | CTGACCCCGTAGGCAGGA | 29 | 5-8-5 | 1640 |
| 623789 | 121478 | 121495 | ACCAGCCTGAGGTCAAGT | 73 | 5-8-5 | 1641 |
| 623790 | 121538 | 121555 | CAGGTCCTCACTTCACAA | 42 | 5-8-5 | 1642 |
| 623791 | 121767 | 121784 | CCGCCTGCTTGCTCGCAA | 92 | 5-8-5 | 1643 |
| 623792 | 121787 | 121804 | AGTGACACGCCACCCTGG | 80 | 5-8-5 | 1644 |
| 623793 | 121797 | 121814 | AAAAGGATGAGTGACAC | 28 | 5-8-5 | 1645 |
| 623794 | 121807 | 121824 | GGTAGCCAGAAAAAGGA | 49 | 5-8-5 | 1646 |

TABLE 31-continued

Inhibition of tau mRNA by 5-10-5 and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 623795 | 121812 | 121829 | CCTTTGGTAGCCAGAAAA | 63 | 5-8-5 | 1647 |
| 623796 | 121817 | 121834 | CTGCACCTTTGGTAGCCA | 87 | 5-8-5 | 1648 |
| 623797 | 121822 | 121839 | ATTATCTGCACCTTTGGT | 67 | 5-8-5 | 1649 |
| 623798 | 121824 | 121841 | TAATTATCTGCACCTTTG | 49 | 5-8-5 | 1650 |
| 623799 | 121905 | 121922 | CACTGCCGCCTCCCGGGA | 65 | 5-8-5 | 1651 |
| 623800 | 121909 | 121926 | CTCACACTGCCGCCTCCC | 75 | 5-8-5 | 1652 |
| 623801 | 121911 | 121928 | TACTCACACTGCCGCCTC | 54 | 5-8-5 | 1653 |
| 623679 | 121913 | 121930 | GGTACTCACACTGCCGCC | 81 | 5-8-5 | 1654 |
| 623802 | 121915 | 121932 | AAGGTACTCACACTGCCG | 69 | 5-8-5 | 1655 |
| 623803 | 121920 | 121937 | GTGTGAAGGTACTCACAC | 18 | 5-8-5 | 1656 |
| 623804 | 121942 | 121959 | GCCACAGCACGGCGCATG | 80 | 5-8-5 | 1657 |
| 623805 | 121952 | 121969 | AATAATTCAAGCCACAGC | 88 | 5-8-5 | 1658 |
| 623806 | 121962 | 121979 | ACCACTTCCTAATAATTC | 39 | 5-8-5 | 1659 |
| 623807 | 121972 | 121989 | ACGCACTCACACCACTTC | 83 | 5-8-5 | 1660 |
| 623808 | 121982 | 121999 | TCGCAAGTGTACGCACTC | 94 | 5-8-5 | 1661 |
| 623809 | 121992 | 122009 | ATGCAGTGTCTCGCAAGT | 93 | 5-8-5 | 1662 |
| 623810 | 122227 | 122244 | TGATGGGTATTCTCAGCT | 77 | 5-8-5 | 1663 |

TABLE 32

Inhibition of tau mRNA by 5-10-5 MOE and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 613412 | 73879 | 73898 | GTGATCTTCCATCACTTCGA | 87 | 5-10-5 | 25 |
| 620887 | 98891 98928 | 98908 98945 | GTTTTCAAACACACCTTC | 83 | 5-8-5 | 665 |
| 622186 | 5897 | 5914 | CCGCTCGGCCGTCCGGCG | 6 | 5-8-5 | 1664 |
| 622187 | 5900 | 5917 | CTGCCGCTCGGCCGTCCG | 6 | 5-8-5 | 1665 |
| 622174 | 103089 | 103106 | CCAGAGCTGGGTGGTGTC | 12 | 5-8-5 | 1666 |
| 622182 | 125760 | 125777 | TGTAGACTATTTGCACCT | 74 | 5-8-5 | 1667 |
| 622120 | 135855 | 135872 | ATCACTGATTTTGAAGTC | 36 | 5-8-5 | 1668 |
| 622121 | 135858 | 135875 | CCCATCACTGATTTTGAA | 59 | 5-8-5 | 1669 |
| 622122 | 135861 | 135878 | ACTCCCATCACTGATTTT | 70 | 5-8-5 | 1670 |
| 622123 | 135864 | 135881 | CTTACTCCCATCACTGAT | 41 | 5-8-5 | 1671 |
| 622124 | 135867 | 135884 | GCTCTTACTCCCATCACT | 82 | 5-8-5 | 1672 |
| 622125 | 135870 | 135887 | TTTGCTCTTACTCCCATC | 87 | 5-8-5 | 1673 |
| 622126 | 135873 | 135890 | AAATTTGCTCTTACTCCC | 62 | 5-8-5 | 1674 |

TABLE 32-continued

Inhibition of tau mRNA by 5-10-5 MOE and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 622127 | 135876 | 135893 | ATGAAATTTGCTCTTACT | 70 | 5-8-5 | 1675 |
| 622128 | 135879 | 135896 | AAGATGAAATTTGCTCTT | 55 | 5-8-5 | 1676 |
| 622129 | 135882 | 135899 | GGAAAGATGAAATTTGCT | 84 | 5-8-5 | 1677 |
| 622130 | 135885 | 135902 | TTTGGAAAGATGAAATTT | 12 | 5-8-5 | 1678 |
| 622131 | 135891 | 135908 | CATCAATTTGGAAAGATG | 43 | 5-8-5 | 1679 |
| 622132 | 135894 | 135911 | ACCCATCAATTTGGAAAG | 18 | 5-8-5 | 1680 |
| 622133 | 135897 | 135914 | CCCACCCATCAATTTGGA | 34 | 5-8-5 | 1681 |
| 622134 | 135900 | 135917 | TAGCCCACCCATCAATTT | 17 | 5-8-5 | 1682 |
| 622135 | 135903 | 135920 | TACTAGCCCACCCATCAA | 14 | 5-8-5 | 1683 |
| 622136 | 135906 | 135923 | TATTACTAGCCCACCCAT | 24 | 5-8-5 | 1684 |
| 622137 | 135909 | 135926 | TTTTATTACTAGCCCACC | 24 | 5-8-5 | 1685 |
| 622138 | 135912 | 135929 | ATATTTTATTACTAGCCC | 33 | 5-8-5 | 1686 |
| 622139 | 135915 | 135932 | TAAATATTTTATTACTAG | 0 | 5-8-5 | 1687 |
| 622140 | 135918 | 135935 | TTTTAAATATTTTATTAC | 0 | 5-8-5 | 1688 |
| 622141 | 135926 | 135943 | ATGTTTTTTTTAAATAT | 0 | 5-8-5 | 1689 |
| 622142 | 135939 | 135956 | GCCATGTTTTTGAATGTT | 60 | 5-8-5 | 1690 |
| 622143 | 135942 | 135959 | GTGGCCATGTTTTTGAAT | 28 | 5-8-5 | 1691 |
| 622144 | 135945 | 135962 | GATGTGGCCATGTTTTTG | 63 | 5-8-5 | 1692 |
| 622145 | 135948 | 135965 | TTGGATGTGGCCATGTTT | 78 | 5-8-5 | 1693 |
| 622146 | 135951 | 135968 | ATGTTGGATGTGGCCATG | 71 | 5-8-5 | 1694 |
| 622147 | 135954 | 135971 | GAAATGTTGGATGTGGCC | 72 | 5-8-5 | 1695 |
| 622148 | 135957 | 135974 | GAGGAAATGTTGGATGTG | 55 | 5-8-5 | 1696 |
| 622149 | 135960 | 135977 | CCTGAGGAAATGTTGGAT | 77 | 5-8-5 | 1697 |
| 622150 | 135963 | 135980 | TTGCCTGAGGAAATGTTG | 55 | 5-8-5 | 1698 |
| 622151 | 139811 | 139828 | CCAAATTCACTTTTACAG | 54 | 5-8-5 | 1699 |
| 622152 | 139813 | 139830 | TTCCAAATTCACTTTTAC | 67 | 5-8-5 | 1700 |
| 622153 | 139815 | 139832 | ATTTCCAAATTCACTTTT | 52 | 5-8-5 | 1701 |
| 622154 | 139817 | 139834 | TTATTTCCAAATTCACTT | 52 | 5-8-5 | 1702 |
| 622155 | 139819 | 139836 | CTTTATTTCCAAATTCAC | 61 | 5-8-5 | 1703 |
| 622156 | 139821 | 139838 | AACTTTATTTCCAAATTC | 26 | 5-8-5 | 1704 |
| 622157 | 139823 | 139840 | ATAACTTTATTTCCAAAT | 23 | 5-8-5 | 1705 |
| 622158 | 139826 | 139843 | GTAATAACTTTATTTCCA | 65 | 5-8-5 | 1706 |
| 622159 | 139828 | 139845 | GAGTAATAACTTTATTTC | 25 | 5-8-5 | 1707 |
| 622160 | 139830 | 139847 | CAGAGTAATAACTTTATT | 9 | 5-8-5 | 1708 |
| 622161 | 139832 | 139849 | ATCAGAGTAATAACTTTA | 23 | 5-8-5 | 1709 |

TABLE 32-continued

Inhibition of tau mRNA by 5-10-5 MOE and 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 622162 | 139834 | 139851 | TAATCAGAGTAATAACTT | 14 | 5-8-5 | 1710 |
| 622163 | 139836 | 139853 | TTTAATCAGAGTAATAAC | 4 | 5-8-5 | 1711 |

TABLE 33

Inhibition of Tau mRNA by 5-8-5 MOE gapmers targeting SEQ ID NO: 5 and 6

| ISIS NO | SEQ ID NO: 5 Start Site | SEQ ID NO: 5 Stop Site | Sequence | % inhibition | SEQ ID NO: 6 Start Site | SEQ ID NO: 6 Stop Site | Motif | SEQ ID NO |
|---|---|---|---|---|---|---|---|---|
| 622164 | n/a | n/a | GCTTCCGCTGTTGGAGTG | 22 | 526 | 543 | 5-8-5 | 1712 |
| 622165 | n/a | n/a | TCAGCTTCCGCTGTTGGA | 15 | 529 | 546 | 5-8-5 | 1713 |
| 622166 | n/a | n/a | TCTTCAGCTTCCGCTGTT | 0 | 532 | 549 | 5-8-5 | 1714 |
| 622167 | n/a | n/a | GCTTCTTCAGCTTCCGCT | 43 | 535 | 552 | 5-8-5 | 1715 |
| 622171 | n/a | n/a | GCCCCCTTGGCTTTTTG | 16 | 652 | 669 | 5-8-5 | 1716 |
| 622172 | n/a | n/a | TCAGCCCCCTTGGCTTTT | 15 | 655 | 672 | 5-8-5 | 1717 |
| 622173 | n/a | n/a | ACCATCAGCCCCCTTGGC | 49 | 659 | 676 | 5-8-5 | 1718 |
| 622175 | n/a | n/a | TCACCAGAGCTGGGTGGT | 15 | 778 | 795 | 5-8-5 | 1719 |
| 622176 | n/a | n/a | GGTTCACCAGAGCTGGGT | 80 | 781 | 798 | 5-8-5 | 1720 |
| 622177 | n/a | n/a | GGAGGTTCACCAGAGCTG | 79 | 784 | 801 | 5-8-5 | 1721 |
| 622178 | n/a | n/a | TTTGGAGGTTCACCAGAG | 45 | 787 | 804 | 5-8-5 | 1722 |
| 622179 | n/a | n/a | GATTTTGGAGGTTCACCA | 68 | 790 | 807 | 5-8-5 | 1723 |
| 622180 | n/a | n/a | TTGCACCTTCCCGCCTCC | 19 | 1046 | 1063 | 5-8-5 | 1724 |
| 622181 | n/a | n/a | AGACTATTTGCACCTTCC | 70 | 1053 | 1070 | 5-8-5 | 1725 |
| 622183 | 3 | 20 | CCCTTCGCGGTCCCTTCG | 0 | n/a | n/a | 5-8-5 | 1726 |
| 622184 | 6 | 23 | CTGCCCTTCGCGGTCCCT | 12 | n/a | n/a | 5-8-5 | 1727 |
| 622185 | 9 | 26 | GCGCTGCCCTTCGCGGTC | 0 | n/a | n/a | 5-8-5 | 1728 |
| 622188 | 424 | 441 | GTCCCCCAAACCCGTACG | 15 | n/a | n/a | 5-8-5 | 1729 |
| 622189 | 427 | 444 | CCTGTCCCCAAACCCGT | 45 | n/a | n/a | 5-8-5 | 1730 |
| 622190 | 430 | 447 | TTTCCTGTCCCCCAAACC | 57 | n/a | n/a | 5-8-5 | 1731 |
| 622191 | 436 | 453 | TTGATCTTTCCTGTCCCC | 74 | n/a | n/a | 5-8-5 | 1732 |
| 622192 | 439 | 456 | CCCTTGATCTTTCCTGTC | 69 | n/a | n/a | 5-8-5 | 1733 |
| 622193 | 442 | 459 | GCCCCCTTGATCTTTCCT | 7 | n/a | n/a | 5-8-5 | 1734 |
| 622194 | 445 | 462 | GTAGCCCCCTTGATCTTT | 3 | n/a | n/a | 5-8-5 | 1735 |
| 622195 | 448 | 465 | GGTGTAGCCCCCTTGATC | 8 | n/a | n/a | 5-8-5 | 1736 |
| 622196 | 451 | 468 | CATGGTGTAGCCCCCTTG | 83 | n/a | n/a | 5-8-5 | 1737 |

TABLE 33-continued

Inhibition of Tau mRNA by 5-8-5 MOE gapmers targeting SEQ ID NO: 5 and 6

| ISIS NO | SEQ ID NO: 5 Start Site | SEQ ID NO: 5 Stop Site | Sequence | % inhibition | SEQ ID NO: 6 Start Site | SEQ ID NO: 6 Stop Site | Motif | SEQ ID NO |
|---|---|---|---|---|---|---|---|---|
| 622168 | 564 | 581 | ATGCGAGCTTGGGTCACG | 65 | 598 | 615 | 5-8-5 | 1738 |
| 622169 | 567 | 584 | ACCATGCGAGCTTGGGTC | 62 | 601 | 618 | 5-8-5 | 1739 |
| 622170 | 570 | 587 | CTGACCATGCGAGCTTGG | 91 | 604 | 621 | 5-8-5 | 1740 |

TABLE 34

Inhibition of tau mRNA by 5-10-5 MOE and 5-8-5 MOE gapmers targeting SEQ ID NO: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 613412 | 73879 | 73898 | GTGATCTTCCATCACTTCGA | 91 | 345 | 364 | 5-10-5 | 25 |
| 620887 | 98891 98928 | 98908 98945 | GTTTTCAAACACACCTTC | 97 | n/a n/a | n/a n/a | 5-8-5 | 665 |
| 621832 | n/a | n/a | GAGCTTTGAGTTGAGGGA | 14 | 1434 | 1451 | 5-8-5 | 1741 |
| 621833 | n/a | n/a | TGCGAGCTTTGAGTTGAG | 0 | 1437 | 1454 | 5-8-5 | 1742 |
| 621834 | n/a | n/a | CCATGCGAGCTTTGAGTT | 10 | 1440 | 1457 | 5-8-5 | 1743 |
| 621835 | n/a | n/a | TGACCATGCGAGCTTTGA | 83 | 1443 | 1460 | 5-8-5 | 1744 |
| 621836 | n/a | n/a | TACTGACCATGCGAGCTT | 91 | 1446 | 1463 | 5-8-5 | 1745 |
| 621848 | n/a | n/a | GATGTCTTGGCTTTTTTG | 3 | 1492 | 1509 | 5-8-5 | 1746 |
| 621849 | n/a | n/a | GTGTGGATGTCTTGGCTT | 15 | 1497 | 1514 | 5-8-5 | 1747 |
| 621812 | 95374 | 95391 | TTCAGAGGGCTCTGGAAG | 0 | 1373 | 1390 | 5-8-5 | 1748 |
| 621813 | 95377 | 95394 | CTTTTCAGAGGGCTCTGG | 44 | 1376 | 1393 | 5-8-5 | 1749 |
| 621814 | 95380 | 95397 | CTGCTTTTCAGAGGGCTC | 56 | 1379 | 1396 | 5-8-5 | 1750 |
| 621815 | 95383 | 95400 | AGGCTGCTTTTCAGAGGG | 38 | 1382 | 1399 | 5-8-5 | 1751 |
| 621816 | 95386 | 95403 | AGCAGGCTGCTTTTCAGA | 40 | 1385 | 1402 | 5-8-5 | 1752 |
| 621817 | 95389 | 95406 | AGCAGCAGGCTGCTTTTC | 26 | 1388 | 1405 | 5-8-5 | 1753 |
| 621818 | 95392 | 95409 | AGCAGCAGCAGGCTGCTT | 12 | 1391 | 1408 | 5-8-5 | 1754 |
| 621819 | 95395 | 95412 | CGGAGCAGCAGCAGGCTG | 23 | 1394 | 1411 | 5-8-5 | 1755 |
| 621820 | 95398 | 95415 | CCGCGGAGCAGCAGCAGG | 34 | 1397 | 1414 | 5-8-5 | 1756 |
| 621821 | 95401 | 95418 | CCCCCGCGGAGCAGCAGC | 50 | 1400 | 1417 | 5-8-5 | 1757 |
| 621822 | 95404 | 95421 | CTTCCCCCGCGGAGCAGC | 48 | 1403 | 1420 | 5-8-5 | 1758 |
| 621823 | 95407 | 95424 | GGGCTTCCCCCGCGGAGC | 0 | 1406 | 1423 | 5-8-5 | 1759 |
| 621824 | 95410 | 95427 | GACGGGCTTCCCCCGCGG | 7 | 1409 | 1426 | 5-8-5 | 1760 |
| 621825 | 95413 | 95430 | GCTGACGGGCTTCCCCCG | 36 | 1412 | 1429 | 5-8-5 | 1761 |
| 621826 | 95416 | 95433 | CCGGCTGACGGGCTTCCC | 54 | 1415 | 1432 | 5-8-5 | 1762 |
| 621827 | 95419 | 95436 | GACCCGGCTGACGGGCTT | 7 | 1418 | 1435 | 5-8-5 | 1763 |
| 621828 | 95423 | 95440 | GAGGGACCCGGCTGACGG | 6 | 1422 | 1439 | 5-8-5 | 1764 |

TABLE 34-continued

Inhibition of tau mRNA by 5-10-5 MOE and 5-8-5 MOE
gapmers targeting SEQ ID NO: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 621829 | 95426 | 95443 | GTTGAGGGACCCGGCTGA | 27 | 1425 | 1442 | 5-8-5 | 1765 |
| 621830 | 95429 | 95446 | TGAGTTGAGGGACCCGGC | 50 | 1428 | 1445 | 5-8-5 | 1766 |
| 621831 | 95432 | 95449 | CTTTGAGTTGAGGGACCC | 50 | 1431 | 1448 | 5-8-5 | 1767 |
| 621837 | 98559 | 98576 | TTTTACTGACCATGCGAG | 77 | 1449 | 1466 | 5-8-5 | 1768 |
| 621838 | 98562 | 98579 | TGCTTTTACTGACCATGC | 95 | 1452 | 1469 | 5-8-5 | 1769 |
| 621839 | 98565 | 98582 | CTTTGCTTTTACTGACCA | 85 | 1455 | 1472 | 5-8-5 | 1770 |
| 621840 | 98568 | 98585 | CGTCTTTGCTTTTACTGA | 66 | 1458 | 1475 | 5-8-5 | 1771 |
| 621841 | 98571 | 98588 | TCCCGTCTTTGCTTTTAC | 79 | 1461 | 1478 | 5-8-5 | 1772 |
| 621842 | 98575 | 98592 | CCAGTCCCGTCTTTGCTT | 87 | 1465 | 1482 | 5-8-5 | 1773 |
| 621843 | 98578 | 98595 | CTTCCAGTCCCGTCTTTG | 64 | 1468 | 1485 | 5-8-5 | 1774 |
| 621844 | 98581 | 98598 | TCGCTTCCAGTCCCGTCT | 88 | 1471 | 1488 | 5-8-5 | 1775 |
| 621845 | 98584 | 98601 | TCATCGCTTCCAGTCCCG | 90 | 1474 | 1491 | 5-8-5 | 1776 |
| 621846 | 98587 | 98604 | TTGTCATCGCTTCCAGTC | 88 | 1477 | 1494 | 5-8-5 | 1777 |
| 621847 | 98590 | 98607 | TTTTTGTCATCGCTTCCA | 80 | 1480 | 1497 | 5-8-5 | 1778 |
| 621850 | 101406 | 101423 | GGTTTTAGCAGAGGAACG | 75 | 1514 | 1531 | 5-8-5 | 1779 |
| 621851 | 101409 | 101426 | CAAGGTTTTAGCAGAGGA | 83 | 1517 | 1534 | 5-8-5 | 1780 |
| 621852 | 101412 | 101429 | TTTCAAGGTTTTAGCAGA | 35 | 1520 | 1537 | 5-8-5 | 1781 |
| 621853 | 101415 | 101432 | ATTTTTCAAGGTTTTAGC | 79 | 1523 | 1540 | 5-8-5 | 1782 |
| 621854 | 101418 | 101435 | CCTATTTTTCAAGGTTTT | 71 | 1526 | 1543 | 5-8-5 | 1783 |
| 621855 | 101425 | 101442 | GGCAAGGCCTATTTTTCA | 83 | 1533 | 1550 | 5-8-5 | 1784 |
| 621856 | 101428 | 101445 | TAAGGCAAGGCCTATTTT | 23 | 1536 | 1553 | 5-8-5 | 1785 |
| 621857 | 101431 | 101448 | GGCTAAGGCAAGGCCTAT | 69 | 1539 | 1556 | 5-8-5 | 1786 |
| 621858 | 101457 | 101474 | TGAGCTACCAGGAGTGGG | 75 | 1565 | 1582 | 5-8-5 | 1787 |
| 621859 | 101460 | 101477 | GTCTGAGCTACCAGGAGT | 78 | 1568 | 1585 | 5-8-5 | 1788 |
| 621860 | 101463 | 101480 | AGGGTCTGAGCTACCAGG | 82 | 1571 | 1588 | 5-8-5 | 1789 |
| 621861 | 101466 | 101483 | CAGAGGGTCTGAGCTACC | 88 | 1574 | 1591 | 5-8-5 | 1790 |
| 621862 | 101469 | 101486 | GATCAGAGGGTCTGAGCT | 72 | 1577 | 1594 | 5-8-5 | 1791 |
| 621863 | 101472 | 101489 | TTGGATCAGAGGGTCTGA | 83 | 1580 | 1597 | 5-8-5 | 1792 |
| 621864 | 101478 | 101495 | GGAGGGTTGGATCAGAGG | 0 | 1586 | 1603 | 5-8-5 | 1793 |
| 621865 | 101481 | 101498 | GCTGGAGGGTTGGATCAG | 16 | 1589 | 1606 | 5-8-5 | 1794 |
| 621866 | 101491 | 101508 | ACACAGCAGGGCTGGAGG | 34 | 1599 | 1616 | 5-8-5 | 1795 |
| 621867 | 101494 | 101511 | GGCACACAGCAGGGCTGG | 67 | 1602 | 1619 | 5-8-5 | 1796 |
| 621868 | 101499 | 101516 | CTCTGGGCACACAGCAGG | 75 | 1607 | 1624 | 5-8-5 | 1797 |
| 621869 | 101502 | 101519 | TGGCTCTGGGCACACAGC | 90 | 1610 | 1627 | 5-8-5 | 1798 |
| 621870 | 101505 | 101522 | AGGTGGCTCTGGGCACAC | 92 | 1613 | 1630 | 5-8-5 | 1799 |
| 621871 | 101508 | 101525 | GGAAGGTGGCTCTGGGCA | 67 | 1616 | 1633 | 5-8-5 | 1800 |
| 621872 | 101511 | 101528 | AGAGGAAGGTGGCTCTGG | 43 | 1619 | 1636 | 5-8-5 | 1801 |

TABLE 34-continued

Inhibition of tau mRNA by 5-10-5 MOE and 5-8-5 MOE gapmers targeting SEQ ID NO: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 621873 | 101514 | 101531 | AGGAGAGGAAGGTGGCTC | 65 | 1622 | 1639 | 5-8-5 | 1802 |
| 621874 | 101517 | 101534 | TTTAGGAGAGGAAGGTGG | 26 | 1625 | 1642 | 5-8-5 | 1803 |
| 621875 | 101520 | 101537 | GTATTTAGGAGAGGAAGG | 0 | 1628 | 1645 | 5-8-5 | 1804 |
| 621876 | 101537 | 101554 | GAAGTGACAGAAGAGACG | 37 | 1645 | 1662 | 5-8-5 | 1805 |
| 621877 | 101540 | 101557 | CGGGAAGTGACAGAAGAG | 59 | 1648 | 1665 | 5-8-5 | 1806 |
| 621878 | 101543 | 101560 | GTTCGGGAAGTGACAGAA | 65 | 1651 | 1668 | 5-8-5 | 1807 |
| 621879 | 101546 | 101563 | CCAGTTCGGGAAGTGACA | 35 | 1654 | 1671 | 5-8-5 | 1808 |
| 621880 | 101549 | 101566 | CTGCCAGTTCGGGAAGTG | 69 | 1657 | 1674 | 5-8-5 | 1809 |
| 621881 | 101552 | 101569 | GAACTGCCAGTTCGGGAA | 48 | 1660 | 1677 | 5-8-5 | 1810 |
| 621882 | 101555 | 101572 | CCAGAACTGCCAGTTCGG | 66 | 1663 | 1680 | 5-8-5 | 1811 |
| 621883 | 101558 | 101575 | GCTCCAGAACTGCCAGTT | 69 | 1666 | 1683 | 5-8-5 | 1812 |
| 621884 | 101561 | 101578 | TTTGCTCCAGAACTGCCA | 74 | 1669 | 1686 | 5-8-5 | 1813 |
| 621885 | 101564 | 101581 | TCCTTTGCTCCAGAACTG | 61 | 1672 | 1689 | 5-8-5 | 1814 |
| 621886 | 101567 | 101584 | ATCTCCTTTGCTCCAGAA | 64 | 1675 | 1692 | 5-8-5 | 1815 |
| 621887 | 101570 | 101587 | TTCATCTCCTTTGCTCCA | 36 | 1678 | 1695 | 5-8-5 | 1816 |
| 621888 | 101573 | 101590 | AGTTTCATCTCCTTTGCT | 32 | 1681 | 1698 | 5-8-5 | 1817 |

TABLE 35

Inhibition of tau mRNA by 5-10-5 MOE and 5-8-5 MOE gapmers targeting SEQ ID NO: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 613412 | 73879 | 73898 | GTGATCTTCCATCACTTCGA | 87 | 345 | 364 | 5-10-5 | 25 |
| 620887 | 98891 98928 | 98908 98945 | GTTTTCAAACACACCTTC | 95 | n/a n/a | n/a n/a | 5-8-5 | 665 |
| 621890 | n/a | n/a | CCCTTGAGTTTCATCTCC | 30 | 1687 | 1704 | 5-8-5 | 1818 |
| 621891 | n/a | n/a | GCCCCCTTGAGTTTCATC | 8 | 1690 | 1707 | 5-8-5 | 1819 |
| 621892 | n/a | n/a | TCAGCCCCCTTGAGTTTC | 0 | 1693 | 1710 | 5-8-5 | 1820 |
| 621893 | n/a | n/a | CCATCAGCCCCCTTGAGT | 4 | 1696 | 1713 | 5-8-5 | 1821 |
| 621894 | n/a | n/a | TTACCATCAGCCCCCTTG | 75 | 1699 | 1716 | 5-8-5 | 1822 |
| 621912 | n/a | n/a | CGCAGAGCTGGGTGGTGT | 0 | 1814 | 1831 | 5-8-5 | 1823 |
| 621913 | n/a | n/a | AGTCGCAGAGCTGGGTGG | 0 | 1817 | 1834 | 5-8-5 | 1824 |
| 621914 | n/a | n/a | CTTAGTCGCAGAGCTGGG | 21 | 1820 | 1837 | 5-8-5 | 1825 |
| 621915 | n/a | n/a | TTGCTTAGTCGCAGAGCT | 12 | 1823 | 1840 | 5-8-5 | 1826 |
| 621916 | n/a | n/a | GACTTGCTTAGTCGCAGA | 29 | 1826 | 1843 | 5-8-5 | 1827 |
| 621925 | n/a | n/a | TTCACCTCTCTCAGATCT | 4 | 1871 | 1888 | 5-8-5 | 1828 |
| 621926 | n/a | n/a | AGGTTCACCTCTCTCAGA | 9 | 1874 | 1891 | 5-8-5 | 1829 |

TABLE 35-continued

Inhibition of tau mRNA by 5-10-5 MOE and 5-8-5 MOE
gapmers targeting SEQ ID NO: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 621927 | n/a | n/a | TGGAGGTTCACCTCTCTC | 7 | 1877 | 1894 | 5-8-5 | 1830 |
| 621928 | n/a | n/a | TTTTGGAGGTTCACCTCT | 11 | 1880 | 1897 | 5-8-5 | 1831 |
| 621889 | 101576 | 101593 | TTGAGTTTCATCTCCTTT | 23 | 1684 | 1701 | 5-8-5 | 1832 |
| 621895 | 102978 | 102995 | GTTTTACCATCAGCCCCC | 88 | 1702 | 1719 | 5-8-5 | 1833 |
| 621896 | 102995 | 103012 | GCGGTGTGGCGATCTTCG | 42 | 1719 | 1736 | 5-8-5 | 1834 |
| 621897 | 102998 | 103015 | CCCGCGGTGTGGCGATCT | 33 | 1722 | 1739 | 5-8-5 | 1835 |
| 621898 | 103001 | 103018 | CTCCCCGCGGTGTGGCGA | 37 | 1725 | 1742 | 5-8-5 | 1836 |
| 621899 | 103004 | 103021 | CTGCTCCCCGCGGTGTGG | 50 | 1728 | 1745 | 5-8-5 | 1837 |
| 621900 | 103007 | 103024 | GGGCTGCTCCCCGCGGTG | 43 | 1731 | 1748 | 5-8-5 | 1838 |
| 621901 | 103025 | 103042 | GGCCCTTCTGGCCTGGAG | 29 | 1749 | 1766 | 5-8-5 | 1839 |
| 621902 | 103029 | 103046 | GCCTGGCCCTTCTGGCCT | 34 | 1753 | 1770 | 5-8-5 | 1840 |
| 621903 | 103032 | 103049 | TTGGCCTGGCCCTTCTGG | 49 | 1756 | 1773 | 5-8-5 | 1841 |
| 621904 | 103050 | 103067 | GCTGGAATCCTGGTGGCG | 58 | 1774 | 1791 | 5-8-5 | 1842 |
| 621905 | 103053 | 103070 | TTTGCTGGAATCCTGGTG | 50 | 1777 | 1794 | 5-8-5 | 1843 |
| 621906 | 103056 | 103073 | GTTTTGCTGGAATCCTG | 62 | 1780 | 1797 | 5-8-5 | 1844 |
| 621907 | 103075 | 103092 | TGTCTTTGGAGCGGGCGG | 21 | 1799 | 1816 | 5-8-5 | 1845 |
| 621908 | 103078 | 103095 | TGGTGTCTTTGGAGCGGG | 57 | 1802 | 1819 | 5-8-5 | 1846 |
| 621909 | 103081 | 103098 | GGGTGGTGTCTTTGGAGC | 17 | 1805 | 1822 | 5-8-5 | 1847 |
| 621910 | 103084 | 103101 | GCTGGGTGGTGTCTTTGG | 44 | 1808 | 1825 | 5-8-5 | 1848 |
| 621911 | 103087 | 103104 | AGAGCTGGGTGGTGTCTT | 47 | 1811 | 1828 | 5-8-5 | 1849 |
| 621917 | 105442 | 105459 | CTGGACTTGCTTAGTCGC | 27 | 1829 | 1846 | 5-8-5 | 1850 |
| 621918 | 105445 | 105462 | TCTCTGGACTTGCTTAGT | 0 | 1832 | 1849 | 5-8-5 | 1851 |
| 621919 | 105448 | 105465 | TCTTCTCTGGACTTGCTT | 48 | 1835 | 1852 | 5-8-5 | 1852 |
| 621920 | 105451 | 105468 | TGGTCTTCTCTGGACTTG | 49 | 1838 | 1855 | 5-8-5 | 1853 |
| 621921 | 105454 | 105471 | GGGTGGTCTTCTCTGGAC | 33 | 1841 | 1858 | 5-8-5 | 1854 |
| 621922 | 105473 | 105490 | CAGATCTGGGCCCTGCAG | 36 | 1860 | 1877 | 5-8-5 | 1855 |
| 621923 | 105476 | 105493 | TCTCAGATCTGGGCCCTG | 70 | 1863 | 1880 | 5-8-5 | 1856 |
| 621924 | 105479 | 105496 | CTCTCTCAGATCTGGGCC | 32 | 1866 | 1883 | 5-8-5 | 1857 |
| 621929 | 107917 | 107934 | TGATTTTGGAGGTTCACC | 44 | 1883 | 1900 | 5-8-5 | 1858 |
| 621930 | 107920 | 107937 | CCCTGATTTTGGAGGTTC | 74 | 1886 | 1903 | 5-8-5 | 1859 |
| 621931 | 107923 | 107940 | ATCCCCTGATTTTGGAGG | 26 | 1889 | 1906 | 5-8-5 | 1860 |
| 621932 | 107926 | 107943 | GCGATCCCTGATTTTGG | 45 | 1892 | 1909 | 5-8-5 | 1861 |
| 621933 | 107929 | 107946 | GCTGCGATCCCTGATTT | 38 | 1895 | 1912 | 5-8-5 | 1862 |
| 621934 | 107932 | 107949 | GCCGCTGCGATCCCCTGA | 42 | 1898 | 1915 | 5-8-5 | 1863 |
| 621935 | 107935 | 107952 | GTAGCCGCTGCGATCCCC | 31 | 1901 | 1918 | 5-8-5 | 1864 |
| 621936 | 107938 | 107955 | GCTGTAGCCGCTGCGATC | 67 | 1904 | 1921 | 5-8-5 | 1865 |

TABLE 35-continued

Inhibition of tau mRNA by 5-10-5 MOE and 5-8-5 MOE gapmers targeting SEQ ID NO: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 621937 | 107941 | 107958 | GCTGCTGTAGCCGCTGCG | 23 | 1907 | 1924 | 5-8-5 | 1866 |
| 621938 | 107971 | 107988 | GCGGCTGCCGGGAGTGCC | 40 | 1937 | 1954 | 5-8-5 | 1867 |
| 621939 | 107974 | 107991 | GGAGCGGCTGCCGGGAGT | 1 | 1940 | 1957 | 5-8-5 | 1868 |
| 621940 | 107978 | 107995 | TGCGGGAGCGGCTGCCGG | 48 | 1944 | 1961 | 5-8-5 | 1869 |
| 621941 | 108021 | 108038 | ACCTTCTTGGGCTCCGG | 24 | 1987 | 2004 | 5-8-5 | 1870 |
| 621942 | 108024 | 108041 | GCCACCTTCTTGGGCTCC | 28 | 1990 | 2007 | 5-8-5 | 1871 |
| 621943 | 108027 | 108044 | ACTGCCACCTTCTTGGGC | 19 | 1993 | 2010 | 5-8-5 | 1872 |
| 621944 | 108030 | 108047 | ACCACTGCCACCTTCTTG | 28 | 1996 | 2013 | 5-8-5 | 1873 |
| 621945 | 108033 | 108050 | CGGACCACTGCCACCTTC | 72 | 1999 | 2016 | 5-8-5 | 1874 |
| 621946 | 108036 | 108053 | GTACGGACCACTGCCACC | 57 | 2002 | 2019 | 5-8-5 | 1875 |
| 621947 | 108039 | 108056 | GGAGTACGGACCACTGCC | 25 | 2005 | 2022 | 5-8-5 | 1876 |
| 621948 | 108042 | 108059 | GGTGGAGTACGGACCACT | 30 | 2008 | 2025 | 5-8-5 | 1877 |
| 621949 | 108045 | 108062 | TTGGGTGGAGTACGGACC | 24 | 2011 | 2028 | 5-8-5 | 1878 |
| 621950 | 108052 | 108069 | CGGCGACTTGGGTGGAGT | 1 | 2018 | 2035 | 5-8-5 | 1879 |
| 621951 | 108055 | 108072 | AGACGGCGACTTGGGTGG | 4 | 2021 | 2038 | 5-8-5 | 1880 |
| 621952 | 108058 | 108075 | GGAAGACGGCGACTTGGG | 50 | 2024 | 2041 | 5-8-5 | 1881 |
| 621953 | 108061 | 108078 | GGCGGAAGACGGCGACTT | 66 | 2027 | 2044 | 5-8-5 | 1882 |
| 621954 | 108064 | 108081 | CTTGGCGGAAGACGGCGA | 38 | 2030 | 2047 | 5-8-5 | 1883 |
| 621955 | 108067 | 108084 | GCTCTTGGCGGAAGACGG | 24 | 2033 | 2050 | 5-8-5 | 1884 |
| 621956 | 108070 | 108087 | GCGGCTCTTGGCGGAAGA | 20 | 2036 | 2053 | 5-8-5 | 1885 |
| 621957 | 108073 | 108090 | CAGGCGGCTCTTGGCGGA | 46 | 2039 | 2056 | 5-8-5 | 1886 |
| 621958 | 108076 | 108093 | CTGCAGGCGGCTCTTGGC | 72 | 2042 | 2059 | 5-8-5 | 1887 |
| 621959 | 108079 | 108096 | TGTCTGCAGGCGGCTCTT | 52 | 2045 | 2062 | 5-8-5 | 1888 |
| 621960 | 108082 | 108099 | GGCTGTCTGCAGGCGGCT | 47 | 2048 | 2065 | 5-8-5 | 1889 |
| 621961 | 108101 | 108118 | GGTCTGGCATGGGCACGG | 73 | 2067 | 2084 | 5-8-5 | 1890 |
| 621962 | 108137 | 108154 | TCTCAGTGGAGCCGATCT | 39 | 2103 | 2120 | 5-8-5 | 1891 |
| 621963 | 108140 | 108157 | GGTTCTCAGTGGAGCCGA | 66 | 2106 | 2123 | 5-8-5 | 1892 |
| 621964 | 108143 | 108160 | TCAGGTTCTCAGTGGAGC | 65 | 2109 | 2126 | 5-8-5 | 1893 |
| 621965 | 108146 | 108163 | GCTTCAGGTTCTCAGTGG | 44 | 2112 | 2129 | 5-8-5 | 1894 |

TABLE 36

Inhibition of tau mRNA by 5-10-5 MOE and 5-8-5 MOE
gapmers targeting SEQ ID NO: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 613412 | 73879 | 73898 | GTGATCTTCCATCACTTCGA | 88 | 345 | 364 | 5-10-5 | 25 |
| 620887 | 98891 | 98908 | GTTTTCAAACACACCTTC | 94 | n/a | n/a | 5-8-5 | 665 |
|  | 98928 | 98945 |  |  | n/a | n/a |  |  |
| 621973 | n/a | n/a | TGCACCTTCCCGCCTCCC | 66 | 2137 | 2154 | 5-8-5 | 1895 |
| 621974 | n/a | n/a | TATCTGCACCTTCCCGCC | 17 | 2141 | 2158 | 5-8-5 | 1896 |
| 621975 | n/a | n/a | AATTATCTGCACCTTCCC | 27 | 2144 | 2161 | 5-8-5 | 1897 |
| 621994 | n/a | n/a | TGCACACTGCCGCCTCCC | 74 | 2230 | 2247 | 5-8-5 | 1898 |
| 621995 | n/a | n/a | ACTATTTGCACACTGCCG | 28 | 2236 | 2253 | 5-8-5 | 1899 |
| 621996 | n/a | n/a | TAGACTATTTGCACACTG | 29 | 2239 | 2256 | 5-8-5 | 1900 |
| 621997 | n/a | n/a | TTGTAGACTATTTGCACA | 62 | 2242 | 2259 | 5-8-5 | 1901 |
| 622012 | n/a | n/a | CTCCTGGTTTATGATGGA | 24 | 2310 | 2327 | 5-8-5 | 1902 |
| 622013 | n/a | n/a | GGCCACCTCCTGGTTTAT | 21 | 2316 | 2333 | 5-8-5 | 1903 |
| 622014 | n/a | n/a | CACCTGGCCACCTCCTGG | 44 | 2321 | 2338 | 5-8-5 | 1904 |
| 622041 | n/a | n/a | ATCTTTTTATTTCCTCCG | 32 | 2422 | 2439 | 5-8-5 | 1905 |
| 622042 | n/a | n/a | TTTCAATCTTTTTATTTC | 16 | 2427 | 2444 | 5-8-5 | 1906 |
| 621966 | 108149 | 108166 | GGTGCTTCAGGTTCTCAG | 48 | 2115 | 2132 | 5-8-5 | 1907 |
| 621967 | 108153 | 108170 | GGCTGGTGCTTCAGGTTC | 46 | 2119 | 2136 | 5-8-5 | 1908 |
| 621968 | 108156 | 108173 | CCCGGCTGGTGCTTCAGG | 50 | 2122 | 2139 | 5-8-5 | 1909 |
| 621969 | 108159 | 108176 | CCTCCCGGCTGGTGCTTC | 22 | 2125 | 2142 | 5-8-5 | 1910 |
| 621970 | 108162 | 108179 | CCGCCTCCCGGCTGGTGC | 27 | 2128 | 2145 | 5-8-5 | 1911 |
| 621971 | 108165 | 108182 | TTCCCGCCTCCCGGCTGG | 5 | 2131 | 2148 | 5-8-5 | 1912 |
| 621972 | 108168 | 108185 | ACCTTCCCGCCTCCCGGC | 39 | 2134 | 2151 | 5-8-5 | 1913 |
| 621976 | 121826 | 121843 | ATTAATTATCTGCACCTT | 76 | 2147 | 2164 | 5-8-5 | 1914 |
| 621977 | 121829 | 121846 | CTTATTAATTATCTGCAC | 73 | 2150 | 2167 | 5-8-5 | 1915 |
| 621978 | 121833 | 121850 | GCTTCTTATTAATTATCT | 68 | 2154 | 2171 | 5-8-5 | 1916 |
| 621979 | 121836 | 121853 | CCAGCTTCTTATTAATTA | 44 | 2157 | 2174 | 5-8-5 | 1917 |
| 621980 | 121839 | 121856 | GATCCAGCTTCTTATTAA | 31 | 2160 | 2177 | 5-8-5 | 1918 |
| 621981 | 121842 | 121859 | TAAGATCCAGCTTCTTAT | 44 | 2163 | 2180 | 5-8-5 | 1919 |
| 621982 | 121845 | 121862 | TGCTAAGATCCAGCTTCT | 69 | 2166 | 2183 | 5-8-5 | 1920 |
| 621983 | 121848 | 121865 | CGTTGCTAAGATCCAGCT | 82 | 2169 | 2186 | 5-8-5 | 1921 |
| 621984 | 121864 | 121881 | CCACACTTGGACTGGACG | 73 | 2185 | 2202 | 5-8-5 | 1922 |
| 621985 | 121867 | 121884 | GAGCCACACTTGGACTGG | 80 | 2188 | 2205 | 5-8-5 | 1923 |
| 621986 | 121870 | 121887 | TTTGAGCCACACTTGGAC | 59 | 2191 | 2208 | 5-8-5 | 1924 |
| 621987 | 121873 | 121890 | TCCTTTGAGCCACACTTG | 66 | 2194 | 2211 | 5-8-5 | 1925 |
| 621988 | 121876 | 121893 | TTATCCTTTGAGCCACAC | 77 | 2197 | 2214 | 5-8-5 | 1926 |
| 621989 | 121879 | 121896 | ATATTATCCTTTGAGCCA | 54 | 2200 | 2217 | 5-8-5 | 1927 |
| 621990 | 121882 | 121899 | TTGATATTATCCTTTGAG | 69 | 2203 | 2220 | 5-8-5 | 1928 |

TABLE 36-continued

Inhibition of tau mRNA by 5-10-5 MOE and 5-8-5 MOE gapmers targeting SEQ ID NO: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 621991 | 121885 | 121902 | TGTTTGATATTATCCTTT | 92 | 2206 | 2223 | 5-8-5 | 1929 |
| 621992 | 121903 | 121920 | CTGCCGCCTCCCGGGACG | 51 | 2224 | 2241 | 5-8-5 | 1930 |
| 621993 | 121906 | 121923 | ACACTGCCGCCTCCCGGG | 70 | 2227 | 2244 | 5-8-5 | 1931 |
| 621998 | 125764 | 125781 | GGTTTGTAGACTATTTGC | 76 | 2245 | 2262 | 5-8-5 | 1932 |
| 621999 | 125767 | 125784 | ACTGGTTTGTAGACTATT | 62 | 2248 | 2265 | 5-8-5 | 1933 |
| 622000 | 125770 | 125787 | TCAACTGGTTTGTAGACT | 39 | 2251 | 2268 | 5-8-5 | 1934 |
| 622001 | 125777 | 125794 | GCTCAGGTCAACTGGTTT | 87 | 2258 | 2275 | 5-8-5 | 1935 |
| 622002 | 125780 | 125797 | CTTGCTCAGGTCAACTGG | 53 | 2261 | 2278 | 5-8-5 | 1936 |
| 622003 | 125783 | 125800 | CACCTTGCTCAGGTCAAC | 68 | 2264 | 2281 | 5-8-5 | 1937 |
| 622004 | 125805 | 125822 | CTAATGAGCCACACTTGG | 51 | 2286 | 2303 | 5-8-5 | 1938 |
| 622005 | 125808 | 125825 | TGCCTAATGAGCCACACT | 65 | 2289 | 2306 | 5-8-5 | 1939 |
| 622006 | 125811 | 125828 | TGTTGCCTAATGAGCCAC | 69 | 2292 | 2309 | 5-8-5 | 1940 |
| 622007 | 125814 | 125831 | GGATGTTGCCTAATGAGC | 70 | 2295 | 2312 | 5-8-5 | 1941 |
| 622008 | 125817 | 125834 | GATGGATGTTGCCTAATG | 61 | 2298 | 2315 | 5-8-5 | 1942 |
| 622009 | 125820 | 125837 | TATGATGGATGTTGCCTA | 44 | 2301 | 2318 | 5-8-5 | 1943 |
| 622010 | 125823 | 125840 | GTTTATGATGGATGTTGC | 57 | 2304 | 2321 | 5-8-5 | 1944 |
| 622011 | 125826 | 125843 | CTGGTTTATGATGGATGT | 26 | 2307 | 2324 | 5-8-5 | 1945 |
| 622015 | 130141 | 130158 | TTTACTTCCACCTGGCCA | 36 | 2329 | 2346 | 5-8-5 | 1946 |
| 622016 | 130144 | 130161 | GATTTTACTTCCACCTGG | 49 | 2332 | 2349 | 5-8-5 | 1947 |
| 622017 | 130147 | 130164 | TCAGATTTTACTTCCACC | 76 | 2335 | 2352 | 5-8-5 | 1948 |
| 622018 | 130150 | 130167 | TTCTCAGATTTTACTTCC | 24 | 2338 | 2355 | 5-8-5 | 1949 |
| 622019 | 130153 | 130170 | AGCTTCTCAGATTTTACT | 30 | 2341 | 2358 | 5-8-5 | 1950 |
| 622020 | 130156 | 130173 | TCAAGCTTCTCAGATTTT | 39 | 2344 | 2361 | 5-8-5 | 1951 |
| 622021 | 130159 | 130176 | AAGTCAAGCTTCTCAGAT | 2 | 2347 | 2364 | 5-8-5 | 1952 |
| 622022 | 130162 | 130179 | TTGAAGTCAAGCTTCTCA | 53 | 2350 | 2367 | 5-8-5 | 1953 |
| 622023 | 130165 | 130182 | TCCTTGAAGTCAAGCTTC | 39 | 2353 | 2370 | 5-8-5 | 1954 |
| 622024 | 130168 | 130185 | CTGTCCTTGAAGTCAAGC | 19 | 2356 | 2373 | 5-8-5 | 1955 |
| 622025 | 130171 | 130188 | ACTCTGTCCTTGAAGTCA | 39 | 2359 | 2376 | 5-8-5 | 1956 |
| 622026 | 130174 | 130191 | TGGACTCTGTCCTTGAAG | 36 | 2362 | 2379 | 5-8-5 | 1957 |
| 622027 | 130177 | 130194 | GACTGGACTCTGTCCTTG | 75 | 2365 | 2382 | 5-8-5 | 1958 |
| 622028 | 130180 | 130197 | TTCGACTGGACTCTGTCC | 29 | 2368 | 2385 | 5-8-5 | 1959 |
| 622029 | 130183 | 130200 | ATCTTCGACTGGACTCTG | 33 | 2371 | 2388 | 5-8-5 | 1960 |
| 622030 | 130186 | 130203 | CCAATCTTCGACTGGACT | 49 | 2374 | 2391 | 5-8-5 | 1961 |
| 622031 | 130189 | 130206 | GACCCAATCTTCGACTGG | 74 | 2377 | 2394 | 5-8-5 | 1962 |
| 622032 | 130192 | 130209 | AGGGACCCAATCTTCGAC | 79 | 2380 | 2397 | 5-8-5 | 1963 |
| 622033 | 130195 | 130212 | TCCAGGGACCCAATCTT | 77 | 2383 | 2400 | 5-8-5 | 1964 |
| 622034 | 130198 | 130215 | TTGTCCAGGGACCCAATC | 68 | 2386 | 2403 | 5-8-5 | 1965 |

TABLE 36-continued

Inhibition of tau mRNA by 5-10-5 MOE and 5-8-5 MOE gapmers targeting SEQ ID NO: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 622035 | 130201 | 130218 | ATATTGTCCAGGGACCCA | 6 | 2389 | 2406 | 5-8-5 | 1966 |
| 622036 | 130204 | 130221 | GTGATATTGTCCAGGGAC | 86 | 2392 | 2409 | 5-8-5 | 1967 |
| 622037 | 130207 | 130224 | TGGGTGATATTGTCCAGG | 68 | 2395 | 2412 | 5-8-5 | 1968 |
| 622038 | 130225 | 130242 | TTTCCTCCGCCAGGGACG | 77 | 2413 | 2430 | 5-8-5 | 1969 |
| 622039 | 130228 | 130245 | TTATTTCCTCCGCCAGGG | 52 | 2416 | 2433 | 5-8-5 | 1970 |
| 622040 | 130231 | 130248 | TTTTTATTTCCTCCGCCA | 61 | 2419 | 2436 | 5-8-5 | 1971 |

TABLE 37

Inhibition of tau mRNA by 5-10-5 MOE and 5-8-5 MOE gapmers targeting SEQ ID NO: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 613412 | 73879 | 73898 | GTGATCTTCCATCACTTCGA | 89 | 345 | 364 | 5-10-5 | 25 |
| 620887 | 98891 98928 | 98908 98945 | GTTTTCAAACACACCTTC | 98 | n/a n/a | n/a n/a | 5-8-5 | 665 |
| 622043 | n/a | n/a | GGGTTTCAATCTTTTTAT | 65 | 2430 | 2447 | 5-8-5 | 1972 |
| 622044 | 135477 | 135494 | GTCAGCTTGTGGGTTTCA | 86 | 2440 | 2457 | 5-8-5 | 1973 |
| 622045 | 135480 | 135497 | AAGGTCAGCTTGTGGGTT | 49 | 2443 | 2460 | 5-8-5 | 1974 |
| 622046 | 135484 | 135501 | GCGGAAGGTCAGCTTGTG | 26 | 2447 | 2464 | 5-8-5 | 1975 |
| 622047 | 135488 | 135505 | TCTCGCGGAAGGTCAGCT | 54 | 2451 | 2468 | 5-8-5 | 1976 |
| 622048 | 135491 | 135508 | CGTTCTCGCGGAAGGTCA | 63 | 2454 | 2471 | 5-8-5 | 1977 |
| 622049 | 135507 | 135524 | TCTGTCTTGGCTTTGGCG | 30 | 2470 | 2487 | 5-8-5 | 1978 |
| 622050 | 135510 | 135527 | TGGTCTGTCTTGGCTTTG | 72 | 2473 | 2490 | 5-8-5 | 1979 |
| 622051 | 135513 | 135530 | CCGTGGTCTGTCTTGGCT | 75 | 2476 | 2493 | 5-8-5 | 1980 |
| 622052 | 135516 | 135533 | GCCCCGTGGTCTGTCTTG | 39 | 2479 | 2496 | 5-8-5 | 1981 |
| 622053 | 135527 | 135544 | ACACGATCTCCGCCCCGT | 80 | 2490 | 2507 | 5-8-5 | 1982 |
| 622054 | 135530 | 135547 | TGTACACGATCTCCGCCC | 72 | 2493 | 2510 | 5-8-5 | 1983 |
| 622055 | 135533 | 135550 | ACTTGTACACGATCTCCG | 30 | 2496 | 2513 | 5-8-5 | 1984 |
| 622056 | 135536 | 135553 | GCGACTTGTACACGATCT | 72 | 2499 | 2516 | 5-8-5 | 1985 |
| 622057 | 135539 | 135556 | CTGGCGACTTGTACACGA | 65 | 2502 | 2519 | 5-8-5 | 1986 |
| 622058 | 135542 | 135559 | CCACTGGCGACTTGTACA | 35 | 2505 | 2522 | 5-8-5 | 1987 |
| 622059 | 135545 | 135562 | ACACCACTGGCGACTTGT | 46 | 2508 | 2525 | 5-8-5 | 1988 |
| 622060 | 135548 | 135565 | CAGACACCACTGGCGACT | 61 | 2511 | 2528 | 5-8-5 | 1989 |
| 622061 | 135551 | 135568 | CCCCAGACACCACTGGCG | 74 | 2514 | 2531 | 5-8-5 | 1990 |
| 622062 | 135554 | 135571 | TGTCCCCAGACACCACTG | 38 | 2517 | 2534 | 5-8-5 | 1991 |
| 622063 | 135572 | 135589 | TGAGATGCCGTGGAGACG | 36 | 2535 | 2552 | 5-8-5 | 1992 |
| 622064 | 135575 | 135592 | TGCTGAGATGCCGTGGAG | 34 | 2538 | 2555 | 5-8-5 | 1993 |

TABLE 37-continued

Inhibition of tau mRNA by 5-10-5 MOE and 5-8-5 MOE
gapmers targeting SEQ ID NO: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 622065 | 135599 | 135616 | CGATGCTGCCGGTGGAGG | 43 | 2562 | 2579 | 5-8-5 | 1994 |
| 622066 | 135602 | 135619 | TGTCGATGCTGCCGGTGG | 51 | 2565 | 2582 | 5-8-5 | 1995 |
| 622067 | 135605 | 135622 | CCATGTCGATGCTGCCGG | 66 | 2568 | 2585 | 5-8-5 | 1996 |
| 622068 | 135608 | 135625 | CTACCATGTCGATGCTGC | 68 | 2571 | 2588 | 5-8-5 | 1997 |
| 622069 | 135611 | 135628 | AGTCTACCATGTCGATGC | 56 | 2574 | 2591 | 5-8-5 | 1998 |
| 622070 | 135614 | 135631 | GCGAGTCTACCATGTCGA | 68 | 2577 | 2594 | 5-8-5 | 1999 |
| 622071 | 135654 | 135671 | AGGGAGGCAGACACCTCG | 24 | 2617 | 2634 | 5-8-5 | 2000 |
| 622072 | 135657 | 135674 | GCCAGGGAGGCAGACACC | 73 | 2620 | 2637 | 5-8-5 | 2001 |
| 622073 | 135661 | 135678 | CTTGGCCAGGGAGGCAGA | 50 | 2624 | 2641 | 5-8-5 | 2002 |
| 622074 | 135664 | 135681 | CTGCTTGGCCAGGGAGGC | 44 | 2627 | 2644 | 5-8-5 | 2003 |
| 622075 | 135667 | 135684 | ACCCTGCTTGGCCAGGGA | 18 | 2630 | 2647 | 5-8-5 | 2004 |
| 622076 | 135678 | 135695 | CCTGATCACAAACCCTGC | 65 | 2641 | 2658 | 5-8-5 | 2005 |
| 622077 | 135681 | 135698 | GGGCCTGATCACAAACCC | 82 | 2644 | 2661 | 5-8-5 | 2006 |
| 622078 | 135697 | 135714 | TTATTGACCGCCCCAGGG | 42 | 2660 | 2677 | 5-8-5 | 2007 |
| 622079 | 135700 | 135717 | CAATTATTGACCGCCCCA | 54 | 2663 | 2680 | 5-8-5 | 2008 |
| 622080 | 135703 | 135720 | CCACAATTATTGACCGCC | 95 | 2666 | 2683 | 5-8-5 | 2009 |
| 622081 | 135706 | 135723 | TCTCCACAATTATTGACC | 63 | 2669 | 2686 | 5-8-5 | 2010 |
| 622082 | 135709 | 135726 | TCCTCTCCACAATTATTG | 41 | 2672 | 2689 | 5-8-5 | 2011 |
| 622083 | 135712 | 135729 | CTCTCCTCTCCACAATTA | 76 | 2675 | 2692 | 5-8-5 | 2012 |
| 622084 | 135715 | 135732 | ATTCTCCTCTCCACAA | 57 | 2678 | 2695 | 5-8-5 | 2013 |
| 622085 | 135718 | 135735 | CTCATTCTCCTCTCCA | 72 | 2681 | 2698 | 5-8-5 | 2014 |
| 622086 | 135721 | 135738 | TCTCTCATTCTCTCCTCT | 69 | 2684 | 2701 | 5-8-5 | 2015 |
| 622087 | 135724 | 135741 | CACTCTCTCATTCTCTCC | 75 | 2687 | 2704 | 5-8-5 | 2016 |
| 622088 | 135727 | 135744 | CCACACTCTCTCATTCTC | 90 | 2690 | 2707 | 5-8-5 | 2017 |
| 622089 | 135730 | 135747 | TTTCCACACTCTCTCATT | 70 | 2693 | 2710 | 5-8-5 | 2018 |
| 622090 | 135733 | 135750 | TTTTTTCCACACTCTCTC | 76 | 2696 | 2713 | 5-8-5 | 2019 |
| 622091 | 135737 | 135754 | CTTTTTTTTCCACACTC | 84 | 2700 | 2717 | 5-8-5 | 2020 |
| 622092 | 135740 | 135757 | ATTCTTTTTTTTCCACA | 67 | 2703 | 2720 | 5-8-5 | 2021 |
| 622093 | 135746 | 135763 | GTCATTATTCTTTTTTT | 54 | 2709 | 2726 | 5-8-5 | 2022 |
| 622094 | 135749 | 135766 | CGGGTCATTATTCTTTTT | 82 | 2712 | 2729 | 5-8-5 | 2023 |
| 622095 | 135752 | 135769 | GGCCGGGTCATTATTCTT | 72 | 2715 | 2732 | 5-8-5 | 2024 |
| 622096 | 135783 | 135800 | CTGCGAGGAGCAGCTGGG | 52 | 2746 | 2763 | 5-8-5 | 2025 |
| 622097 | 135786 | 135803 | GAACTGCGAGGAGCAGCT | 59 | 2749 | 2766 | 5-8-5 | 2026 |
| 622098 | 135789 | 135806 | ACCGAACTGCGAGGAGCA | 77 | 2752 | 2769 | 5-8-5 | 2027 |
| 622099 | 135792 | 135809 | TTAACCGAACTGCGAGGA | 62 | 2755 | 2772 | 5-8-5 | 2028 |
| 622100 | 135795 | 135812 | CAATTAACCGAACTGCGA | 55 | 2758 | 2775 | 5-8-5 | 2029 |

TABLE 37-continued

Inhibition of tau mRNA by 5-10-5 MOE and 5-8-5 MOE gapmers targeting SEQ ID NO: 1 and 2

| ISIS NO | SEQ ID NO: 1 start site | SEQ ID NO: 1 stop site | Sequence | % inhibition | SEQ ID NO: 2 start site | SEQ ID NO: 2 stop site | Motif | SEQ ID NO: |
|---|---|---|---|---|---|---|---|---|
| 622101 | 135798 | 135815 | AACCAATTAACCGAACTG | 59 | 2761 | 2778 | 5-8-5 | 2030 |
| 622102 | 135801 | 135818 | ATTAACCAATTAACCGAA | 71 | 2764 | 2781 | 5-8-5 | 2031 |
| 622103 | 135804 | 135821 | GTGATTAACCAATTAACC | 70 | 2767 | 2784 | 5-8-5 | 2032 |
| 622104 | 135807 | 135824 | TAAGTGATTAACCAATTA | 42 | 2770 | 2787 | 5-8-5 | 2033 |
| 622105 | 135810 | 135827 | GGTTAAGTGATTAACCAA | 42 | 2773 | 2790 | 5-8-5 | 2034 |
| 622106 | 135813 | 135830 | GCAGGTTAAGTGATTAAC | 78 | 2776 | 2793 | 5-8-5 | 2035 |
| 622107 | 135816 | 135833 | AAAGCAGGTTAAGTGATT | 38 | 2779 | 2796 | 5-8-5 | 2036 |
| 622108 | 135819 | 135836 | ACAAAAGCAGGTTAAGTG | 55 | 2782 | 2799 | 5-8-5 | 2037 |
| 622109 | 135822 | 135839 | GTGACAAAAGCAGGTTAA | 82 | 2785 | 2802 | 5-8-5 | 2038 |
| 622110 | 135825 | 135842 | CGAGTGACAAAAGCAGGT | 86 | 2788 | 2805 | 5-8-5 | 2039 |
| 622111 | 135828 | 135845 | AGCCGAGTGACAAAAGCA | 93 | 2791 | 2808 | 5-8-5 | 2040 |
| 622112 | 135831 | 135848 | CAAAGCCGAGTGACAAAA | 73 | 2794 | 2811 | 5-8-5 | 2041 |
| 622113 | 135834 | 135851 | AGCCAAAGCCGAGTGACA | 82 | 2797 | 2814 | 5-8-5 | 2042 |
| 622114 | 135837 | 135854 | CCGAGCCAAAGCCGAGTG | 82 | 2800 | 2817 | 5-8-5 | 2043 |
| 622115 | 135840 | 135857 | GTCCCGAGCCAAAGCCGA | 63 | 2803 | 2820 | 5-8-5 | 2044 |
| 622116 | 135843 | 135860 | GAAGTCCCGAGCCAAAGC | 59 | 2806 | 2823 | 5-8-5 | 2045 |
| 622117 | 135846 | 135863 | TTTGAAGTCCCGAGCCAA | 76 | 2809 | 2826 | 5-8-5 | 2046 |
| 622118 | 135849 | 135866 | GATTTGAAGTCCCGAGC | 72 | 2812 | 2829 | 5-8-5 | 2047 |
| 622119 | 135852 | 135869 | ACTGATTTTGAAGTCCCG | 73 | 2815 | 2832 | 5-8-5 | 2048 |

TABLE 38

Inhibition of tau mRNA by 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 620887 | 98891 98928 | 98908 98945 | GTTTTCAAACACACCTTC | 96 | 5-8-5 | 665 |
| 623853 | 12069 | 12086 | TGTTTGGATTTCTATCGG | 82 | 5-8-5 | 2049 |
| 623854 | 12077 | 12094 | TGACATGGTGTTTGGATT | 47 | 5-8-5 | 2050 |
| 623855 | 12079 | 12096 | GCTGACATGGTGTTTGGA | 77 | 5-8-5 | 2051 |
| 623856 | 12080 | 12097 | CGCTGACATGGTGTTTGG | 78 | 5-8-5 | 2052 |
| 623857 | 12081 | 12098 | TCGCTGACATGGTGTTTG | 83 | 5-8-5 | 2053 |
| 623858 | 12082 | 12099 | CTCGCTGACATGGTGTTT | 84 | 5-8-5 | 2054 |
| 623859 | 12083 | 12100 | ACTCGCTGACATGGTGTT | 74 | 5-8-5 | 2055 |
| 623860 | 12084 | 12101 | GACTCGCTGACATGGTGT | 89 | 5-8-5 | 2056 |
| 623861 | 12085 | 12102 | GGACTCGCTGACATGGTG | 77 | 5-8-5 | 2057 |
| 623862 | 16753 | 16770 | TTATCCAGGAAAAATATT | 21 | 5-8-5 | 2058 |

TABLE 38-continued

Inhibition of tau mRNA by 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 623863 | 16756 | 16773 | GGATTATCCAGGAAAAAT | 86 | 5-8-5 | 2059 |
| 623864 | 16758 | 16775 | TAGGATTATCCAGGAAAA | 76 | 5-8-5 | 2060 |
| 623865 | 16759 | 16776 | ATAGGATTATCCAGGAAA | 84 | 5-8-5 | 2061 |
| 623866 | 16760 | 16777 | TATAGGATTATCCAGGAA | 62 | 5-8-5 | 2062 |
| 623867 | 16761 | 16778 | CTATAGGATTATCCAGGA | 87 | 5-8-5 | 2063 |
| 623868 | 16763 | 16780 | CCCTATAGGATTATCCAG | 76 | 5-8-5 | 2064 |
| 623869 | 16764 | 16781 | TCCCTATAGGATTATCCA | 34 | 5-8-5 | 2065 |
| 623870 | 16766 | 16783 | TATCCCTATAGGATTATC | 56 | 5-8-5 | 2066 |
| 623871 | 16769 | 16786 | AGTTATCCCTATAGGATT | 16 | 5-8-5 | 2067 |
| 623872 | 16774 | 16791 | AGGCAAGTTATCCCTATA | 86 | 5-8-5 | 2068 |
| 623873 | 17416 | 17433 | ATCAGCACCTGACTGCGG | 78 | 5-8-5 | 2069 |
| 623874 | 17421 | 17438 | TTCAGATCAGCACCTGAC | 91 | 5-8-5 | 2070 |
| 623875 | 17424 | 17441 | GACTTCAGATCAGCACCT | 92 | 5-8-5 | 2071 |
| 623876 | 17426 | 17443 | AAGACTTCAGATCAGCAC | 92 | 5-8-5 | 2072 |
| 623877 | 17427 | 17444 | AAAGACTTCAGATCAGCA | 95 | 5-8-5 | 2073 |
| 623878 | 17428 | 17445 | CAAAGACTTCAGATCAGC | 96 | 5-8-5 | 2074 |
| 623879 | 17429 | 17446 | CCAAAGACTTCAGATCAG | 86 | 5-8-5 | 2075 |
| 623880 | 17430 | 17447 | ACCAAAGACTTCAGATCA | 65 | 5-8-5 | 2076 |
| 623881 | 17431 | 17448 | CACCAAAGACTTCAGATC | 51 | 5-8-5 | 2077 |
| 623882 | 17432 | 17449 | CCACCAAAGACTTCAGAT | 55 | 5-8-5 | 2078 |
| 623883 | 17434 | 17451 | GCCCACCAAAGACTTCAG | 77 | 5-8-5 | 2079 |
| 623884 | 17437 | 17454 | TCAGCCCACCAAAGACTT | 56 | 5-8-5 | 2080 |
| 623885 | 17442 | 17459 | TAAAGTCAGCCCACCAAA | 2 | 5-8-5 | 2081 |
| 623886 | 20943 | 20960 | GTTATTGGGACTGACCTT | 69 | 5-8-5 | 2082 |
| 623887 | 20948 | 20965 | GATTTGTTATTGGGACTG | 78 | 5-8-5 | 2083 |
| 613412 | 73879 | 73898 | GTGATCTTCCATCACTTCGA | 89 | 5-8-5 | 25 |
| 623811 | 122370 | 122387 | CAGTGGAGCCACTCAACG | 41 | 5-8-5 | 2084 |
| 623812 | 122380 | 122397 | CACCTGTCCACAGTGGAG | 58 | 5-8-5 | 2085 |
| 623813 | 122391 | 122408 | AACAAACGGGTCACCTGT | 63 | 5-8-5 | 2086 |
| 623814 | 122445 | 122462 | CGTGTAGGAGCAGCAGCT | 81 | 5-8-5 | 2087 |
| 623815 | 122538 | 122555 | CTTTGGTTTGGCTCTTTG | 64 | 5-8-5 | 2088 |
| 623816 | 123104 | 123121 | GCTGGTGGGAGAGGAGCC | 9 | 5-8-5 | 2089 |
| 623817 | 123288 | 123305 | ATGCGGGTGGCTGCCTCA | 65 | 5-8-5 | 2090 |
| 623818 | 123293 | 123310 | GCTGGATGCGGGTGGCTG | 24 | 5-8-5 | 2091 |
| 623819 | 123341 | 123358 | GTGCTCAGGGCAGGAAGC | 45 | 5-8-5 | 2092 |
| 623820 | 123590 | 123607 | CAAAGCTCAAACAGCTGA | 56 | 5-8-5 | 2093 |
| 623821 | 123601 | 123618 | AGAACCAGGATCAAAGCT | 41 | 5-8-5 | 2094 |

TABLE 38-continued

Inhibition of tau mRNA by 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 623822 | 123704 | 123721 | GCTCCGCCTCAGCAGCAC | 71 | 5-8-5 | 2095 |
| 623823 | 123722 | 123739 | GTGTGCACTCTCTCCCCA | 45 | 5-8-5 | 2096 |
| 623824 | 123877 | 123894 | GGCTAGCCCGCAGACGAG | 31 | 5-8-5 | 2097 |
| 623825 | 123976 | 123993 | CCTGTGAAGGTGCTCAGA | 58 | 5-8-5 | 2098 |
| 623826 | 124033 | 124050 | GATCCAGTGCCCCCAGAT | 54 | 5-8-5 | 2099 |
| 623827 | 124057 | 124074 | GGAGAGGCTAGGGCTCAG | 68 | 5-8-5 | 2100 |
| 623828 | 124223 | 124240 | AGAGGAGTGGATGGCAGT | 37 | 5-8-5 | 2101 |
| 623829 | 124293 | 124310 | TGGCCTGGGTGAGGTAAC | 23 | 5-8-5 | 2102 |
| 623830 | 124296 | 124313 | CTCTGGCCTGGGTGAGGT | 28 | 5-8-5 | 2103 |
| 623831 | 124596 | 124613 | AGGGCAGGTGGTGGTTTC | 8 | 5-8-5 | 2104 |
| 623832 | 124780 | 124797 | GACATTCCTGGAGTCCCC | 83 | 5-8-5 | 2105 |
| 623833 | 124859 | 124876 | TGGCAGACAGACAGGTCC | 87 | 5-8-5 | 2106 |
| 623834 | 124909 | 124926 | AGTCAAAGAACCAGCTCC | 68 | 5-8-5 | 2107 |
| 623835 | 124949 | 124966 | TCCCTCTGGGAATGATGA | 41 | 5-8-5 | 2108 |
| 623836 | 124965 | 124982 | GCCTCCAGGGCACCGCTC | 76 | 5-8-5 | 2109 |
| 623837 | 124972 | 124989 | GCCTGTGGCCTCCAGGGC | 43 | 5-8-5 | 2110 |
| 623838 | 124977 | 124994 | AGGAGGCCTGTGGCCTCC | 11 | 5-8-5 | 2111 |
| 623839 | 125075 | 125092 | AATAGGAACAAAGCAACA | 25 | 5-8-5 | 2112 |
| 623840 | 125086 | 125103 | CTGTCTTTAGCAATAGGA | 84 | 5-8-5 | 2113 |
| 623841 | 125100 | 125117 | TGTCCTGGACATTCCTGT | 66 | 5-8-5 | 2114 |
| 623842 | 125291 | 125308 | TGGAAAGGCAGGAGTGGG | 0 | 5-8-5 | 2115 |
| 623843 | 125306 | 125323 | TCTGAAAATCTTGCTGG | 51 | 5-8-5 | 2116 |
| 623844 | 125310 | 125327 | AGCATCTGAAAATCTTG | 82 | 5-8-5 | 2117 |
| 623845 | 125322 | 125339 | ATGAGTATGCACAGCATC | 68 | 5-8-5 | 2118 |
| 623846 | 125337 | 125354 | AAAGTGATCAATATGATG | 33 | 5-8-5 | 2119 |
| 623847 | 125390 | 125407 | GTCACTCCCTTTCCTGAC | 68 | 5-8-5 | 2120 |
| 623848 | 125408 | 125425 | ACGCTTAAGTGTAAAAAT | 38 | 5-8-5 | 2121 |
| 623849 | 125557 | 125574 | AAATGTGTTGTCGAAATT | 19 | 5-8-5 | 2122 |
| 623850 | 125567 | 125584 | CAGGGTGGAAAAATGTGT | 33 | 5-8-5 | 2123 |
| 623851 | 125598 | 125615 | TTCCCAGCTGCCATGAGG | 33 | 5-8-5 | 2124 |
| 623852 | 125743 | 125760 | TGGAGATGAGAGAGGAGG | 0 | 5-8-5 | 2125 |

TABLE 39

Inhibition of Tau mRNA by 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 623661 | 6196 | 6213 | GCGCTTACCTGATAGTCG | 36 | 5-8-5 | 2126 |
| 613412 | 73879 | 73898 | GTGATCTTCCATCACTTCGA | 87 | 5-8-5 | 25 |
| 623662 | 73981 | 73998 | TCCACTAACCTTTCAGGC | 30 | 5-8-5 | 2127 |
| 623663 | 83368 | 83385 | GGGAGATTCTGGAACACA | 72 | 5-8-5 | 2128 |
| 623664 | 83455 | 83472 | GGGCCCACCTTCCGCTGT | 22 | 5-8-5 | 2129 |
| 623665 | 85895 | 85912 | CTGTCACATCTAGAAACC | 21 | 5-8-5 | 2130 |
| 623666 | 85982 | 85999 | TACCCTCACCTGTGGTTC | 0 | 5-8-5 | 2131 |
| 623667 | 89885 | 89902 | CTTCTTCAGCTGGTGTAT | 22 | 5-8-5 | 2132 |
| 623668 | 89951 | 89968 | TTCACTGACCTTGGGTCA | 0 | 5-8-5 | 2133 |
| 623669 | 94688 | 94705 | TTTCAGGCTCTGTGTGGA | 61 | 5-8-5 | 2134 |
| 623670 | 95441 | 95458 | GACACAGACCTTTGAGTT | 53 | 5-8-5 | 2135 |
| 623671 | 98550 | 98567 | CCATGCGAGCTGATAAAA | 39 | 5-8-5 | 2136 |
| 621344 | 98607 | 98624 | GTCAGCTTACCTTGGCTT | 34 | 5-8-5 | 814 |
| 620887 | 98891 98928 | 98908 98945 | GTTTTCAAACACACCTTC | 94 | 5-8-5 | 665 |
| 623672 | 101387 | 101404 | GTGGATGTCTTAAACATA | 89 | 5-8-5 | 2137 |
| 623673 | 101586 | 101603 | TTTCCTTACCTTGAGTTT | 0 | 5-8-5 | 2138 |
| 623674 | 102970 | 102987 | ATCAGCCCCTGTAAATG | 7 | 5-8-5 | 2139 |
| 623675 | 103097 | 103114 | TCTTCTTACCAGAGCTGG | 0 | 5-8-5 | 2140 |
| 623676 | 107909 | 107926 | GAGGTTCACCTGGGAAGG | 0 | 5-8-5 | 2141 |
| 623677 | 108175 | 108192 | CACTCTCACCTTCCCGCC | 6 | 5-8-5 | 2142 |
| 623712 | 108255 | 108272 | CCTCCAGGCGCAGCCCTA | 92 | 5-8-5 | 2143 |
| 623713 | 108413 | 108430 | CCTGAGGAGGGCACTCAC | 28 | 5-8-5 | 2144 |
| 623714 | 108530 | 108547 | GGAACCGCTGTGGGTGCC | 60 | 5-8-5 | 2145 |
| 623715 | 108565 | 108582 | TGGGTGGCAGTGTATTCT | 63 | 5-8-5 | 2146 |
| 623716 | 108690 | 108707 | GGAGAGCTCGCGAGCACC | 69 | 5-8-5 | 2147 |
| 623717 | 108896 | 108913 | GAGGTGGCTACCCACGGC | 59 | 5-8-5 | 2148 |
| 623718 | 109561 | 109578 | CCAGAAGGCCCAGCACAT | 51 | 5-8-5 | 2149 |
| 623719 | 109574 | 109591 | CGAGGCCCAGTGCCCAGA | 59 | 5-8-5 | 2150 |
| 623720 | 109607 | 109624 | AGGCCCAGGGTTCCAGAA | 55 | 5-8-5 | 2151 |
| 623721 | 109623 | 109640 | AGGCAAGCTGACACGCAG | 73 | 5-8-5 | 2152 |
| 623722 | 110101 | 110118 | CAGGAAAAGGCCGGACCT | 37 | 5-8-5 | 2153 |
| 623723 | 110103 | 110120 | AGCAGGAAAAGGCCGGAC | 78 | 5-8-5 | 2154 |
| 623724 | 110182 | 110199 | TTCCCCAAGGTCTCTAAC | 14 | 5-8-5 | 2155 |
| 623725 | 110413 | 110430 | AGGAAAGGCCAGTGAGGG | 8 | 5-8-5 | 2156 |
| 623726 | 110500 | 110517 | TTGTTATGTGACTTGAGG | 74 | 5-8-5 | 2157 |
| 623727 | 110630 | 110647 | ATTCCCCACCATGGGACA | 17 | 5-8-5 | 2158 |

TABLE 39-continued

Inhibition of Tau mRNA by 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 623728 | 110635 | 110652 | AGGACATTCCCCACCATG | 9 | 5-8-5 | 2159 |
| 623729 | 110648 | 110665 | AGATAAGGAGAGAAGGAC | 15 | 5-8-5 | 2160 |
| 623730 | 110755 | 110772 | ATGCTCAGTGTGGTCAGA | 73 | 5-8-5 | 2161 |
| 623731 | 110852 | 110869 | AGGGCCGGCCACCTGCAC | 56 | 5-8-5 | 2162 |
| 623732 | 110919 | 110936 | TCTGTCTCTGGCAACCTG | 85 | 5-8-5 | 2163 |
| 623733 | 110954 | 110971 | AACAGGGAAGCTACTTCC | 6 | 5-8-5 | 2164 |
| 623734 | 111077 | 111094 | GGGCCTTCAATGGAAAGT | 21 | 5-8-5 | 2165 |
| 623735 | 111153 | 111170 | GGTCGCCTGACTCTCACC | 66 | 5-8-5 | 2166 |
| 623736 | 111174 | 111191 | CCCTTTCTACACTTGGCA | 81 | 5-8-5 | 2167 |
| 623678 | 121820 | 121837 | TATCTGCACCTTTGGTAG | 30 | 5-8-5 | 2168 |
| 623685 | 121830 | 121847 | TCTTATTAATTATCTGCA | 81 | 5-8-5 | 2169 |
| 623686 | 121831 | 121848 | TTCTTATTAATTATCTGC | 74 | 5-8-5 | 2170 |
| 623687 | 121834 | 121851 | AGCTTCTTATTAATTATC | 46 | 5-8-5 | 2171 |
| 623688 | 121835 | 121852 | CAGCTTCTTATTAATTAT | 6 | 5-8-5 | 2172 |
| 623689 | 121837 | 121854 | TCCAGCTTCTTATTAATT | 4 | 5-8-5 | 2173 |
| 623690 | 121838 | 121855 | ATCCAGCTTCTTATTAAT | 2 | 5-8-5 | 2174 |
| 623691 | 121840 | 121857 | AGATCCAGCTTCTTATTA | 2 | 5-8-5 | 2175 |
| 623692 | 121841 | 121858 | AAGATCCAGCTTCTTATT | 17 | 5-8-5 | 2176 |
| 623693 | 121843 | 121860 | CTAAGATCCAGCTTCTTA | 41 | 5-8-5 | 2177 |
| 623694 | 121844 | 121861 | GCTAAGATCCAGCTTCTT | 75 | 5-8-5 | 2178 |
| 623695 | 121846 | 121863 | TTGCTAAGATCCAGCTTC | 50 | 5-8-5 | 2179 |
| 623696 | 121847 | 121864 | GTTGCTAAGATCCAGCTT | 52 | 5-8-5 | 2180 |
| 623697 | 121865 | 121882 | GCCACACTTGGACTGGAC | 88 | 5-8-5 | 2181 |
| 623698 | 121866 | 121883 | AGCCACACTTGGACTGGA | 89 | 5-8-5 | 2182 |
| 623699 | 121868 | 121885 | TGAGCCACACTTGGACTG | 59 | 5-8-5 | 2183 |
| 623700 | 121869 | 121886 | TTGAGCCACACTTGGACT | 62 | 5-8-5 | 2184 |
| 623701 | 121872 | 121889 | CCTTTGAGCCACACTTGG | 69 | 5-8-5 | 2185 |
| 623702 | 121874 | 121891 | ATCCTTTGAGCCACACTT | 64 | 5-8-5 | 2186 |
| 623703 | 121875 | 121892 | TATCCTTTGAGCCACACT | 69 | 5-8-5 | 2187 |
| 623704 | 121877 | 121894 | ATTATCCTTTGAGCCACA | 76 | 5-8-5 | 2188 |
| 623705 | 121878 | 121895 | TATTATCCTTTGAGCCAC | 76 | 5-8-5 | 2189 |
| 623706 | 121880 | 121897 | GATATTATCCTTTGAGCC | 54 | 5-8-5 | 2190 |
| 623707 | 121881 | 121898 | TGATATTATCCTTTGAGC | 65 | 5-8-5 | 2191 |
| 623708 | 121884 | 121901 | GTTTGATATTATCCTTTG | 94 | 5-8-5 | 2192 |
| 623709 | 121886 | 121903 | GTGTTTGATATTATCCTT | 85 | 5-8-5 | 2193 |
| 623710 | 121887 | 121904 | CGTGTTTGATATTATCCT | 78 | 5-8-5 | 2194 |
| 623711 | 121904 | 121921 | ACTGCCGCCTCCCGGGAC | 50 | 5-8-5 | 2195 |

TABLE 39-continued

Inhibition of Tau mRNA by 5-8-5 MOE gapmers targeting SEQ ID NO: 1

| ISIS NO | SEQ ID NO: 1 start site | SEQ ID NO: 1 stop site | Sequence | % inhibition | Motif | SEQ ID NO: |
|---|---|---|---|---|---|---|
| 623679 | 121913 | 121930 | GGTACTCACACTGCCGCC | 72 | 5-8-5 | 1654 |
| 623680 | 125753 | 125770 | TATTTGCACCTGGAGATG | 0 | 5-8-5 | 2196 |
| 623681 | 125835 | 125852 | CAGGGCTACCTGGTTTAT | 26 | 5-8-5 | 2197 |
| 623682 | 130128 | 130145 | GGCCACCTCCTAGAACAC | 8 | 5-8-5 | 2198 |
| 623683 | 130241 | 130258 | CCCCTTTACCTTTTTATT | 0 | 5-8-5 | 2199 |
| 623684 | 135466 | 135483 | GGTTTCAATCTGCAAGAA | 39 | 5-8-5 | 2200 |

Example 11

Dose-Dependent Antisense Inhibition of Human Tau in SH-SY5Y Cells

Gapmers from studies described above exhibiting significant in vitro inhibition of tau mRNA were selected and tested at various doses in SH-SY5Y cells. The antisense oligonucleotides were tested in a series of experiments that had similar culture conditions. The results for each experiment are presented in separate tables shown below. Cells were plated at a density of 20,000 cells per well and transfected using electroporation with 0.938 µM, 0.1.875 µM, 3.750 µM, 7.500 µM, and 15.00 µM concentrations of antisense oligonucleotide, as specified in the Tables below. After a treatment period of approximately 16 hours, RNA was isolated from the cells and tau mRNA levels were measured by quantitative real-time PCR. Human primer probe set RTS3104 was used to measure mRNA levels. Tau mRNA levels were adjusted according to total RNA content, as measured by RIBOGREEN®. Results are presented as percent inhibition of tau, relative to untreated control cells. Tau mRNA levels were significantly reduced in a dose-dependent manner in antisense oligonucleotide treated cells.

TABLE 40

| ISIS No | 0.938 µM | 1.875 µM | 3.750 µM | 7.500 µM | 15.00 µM |
|---|---|---|---|---|---|
| 613369 | 57 | 67 | 81 | 91 | 96 |
| 613370 | 83 | 91 | 96 | 98 | 97 |
| 613371 | 68 | 78 | 95 | 95 | 97 |
| 613412 | 41 | 55 | 73 | 86 | 96 |
| 620887 | 53 | 76 | 90 | 93 | 95 |
| 621238 | 58 | 80 | 76 | 93 | 96 |
| 621251 | 68 | 77 | 87 | 89 | 90 |
| 621263 | 57 | 69 | 81 | 92 | 95 |
| 621302 | 46 | 66 | 80 | 78 | 87 |
| 621309 | 56 | 64 | 84 | 86 | 90 |
| 621311 | 38 | 54 | 69 | 77 | 86 |
| 621312 | 42 | 36 | 57 | 83 | 90 |
| 621318 | 40 | 54 | 71 | 87 | 87 |
| 621346 | 42 | 46 | 60 | 64 | 78 |
| 621870 | 42 | 62 | 76 | 85 | 92 |

TABLE 41

| ISIS No | 0.938 µM | 1.875 µM | 3.750 µM | 7.500 µM | 15.00 µM |
|---|---|---|---|---|---|
| 613412 | 14 | 45 | 68 | 84 | 92 |
| 620887 | 57 | 74 | 87 | 93 | 95 |
| 620888 | 63 | 78 | 76 | 94 | 96 |
| 620890 | 76 | 86 | 92 | 96 | 97 |
| 620891 | 67 | 79 | 91 | 96 | 96 |
| 620918 | 38 | 55 | 65 | 81 | 88 |
| 620940 | 38 | 52 | 73 | 89 | 96 |
| 620947 | 26 | 47 | 58 | 78 | 87 |
| 620958 | 32 | 38 | 61 | 79 | 93 |
| 621013 | 49 | 75 | 86 | 92 | 94 |
| 621049 | 38 | 45 | 68 | 78 | 80 |
| 621056 | 40 | 45 | 70 | 81 | 90 |
| 621078 | 23 | 28 | 48 | 67 | 84 |
| 621082 | 22 | 32 | 53 | 62 | 90 |
| 621088 | 26 | 43 | 59 | 80 | 92 |

TABLE 42

| ISIS No | 0.938 µM | 1.875 µM | 3.750 µM | 7.500 µM | 15.00 µM |
|---|---|---|---|---|---|
| 613412 | 17 | 45 | 62 | 84 | 89 |
| 620887 | 52 | 71 | 91 | 96 | 95 |
| 621147 | 28 | 37 | 59 | 69 | 84 |
| 621181 | 39 | 61 | 78 | 85 | 83 |
| 621183 | 31 | 43 | 64 | 72 | 87 |
| 621836 | 24 | 39 | 64 | 81 | 93 |
| 621838 | 33 | 59 | 70 | 91 | 97 |
| 621844 | 20 | 38 | 64 | 80 | 91 |
| 621845 | 30 | 37 | 62 | 72 | 90 |
| 621861 | 19 | 35 | 59 | 80 | 92 |
| 621869 | 30 | 56 | 64 | 83 | 91 |
| 622125 | 14 | 28 | 52 | 73 | 85 |
| 622129 | 26 | 36 | 60 | 71 | 84 |
| 622170 | 18 | 42 | 72 | 77 | 91 |
| 622196 | 11 | 39 | 59 | 74 | 89 |

TABLE 43

| ISIS No | 0.938 µM | 1.875 µM | 3.750 µM | 7.500 µM | 15.00 µM |
|---|---|---|---|---|---|
| 613412 | 21 | 42 | 64 | 82 | 95 |
| 620887 | 60 | 79 | 92 | 95 | 95 |
| 623746 | 19 | 43 | 54 | 81 | 91 |
| 623750 | 50 | 63 | 75 | 83 | 90 |
| 623758 | 37 | 54 | 72 | 80 | 82 |
| 623805 | 25 | 33 | 48 | 74 | 86 |
| 623807 | 15 | 29 | 44 | 75 | 88 |
| 623833 | 16 | 60 | 65 | 86 | 89 |
| 623860 | 51 | 71 | 80 | 85 | 85 |
| 623867 | 9 | 51 | 48 | 74 | 86 |
| 623874 | 24 | 28 | 72 | 84 | 94 |

TABLE 43-continued

| ISIS No | 0.938 µM | 1.875 µM | 3.750 µM | 7.500 µM | 15.00 µM |
|---|---|---|---|---|---|
| 623875 | 38 | 62 | 80 | 93 | 95 |
| 623876 | 40 | 63 | 83 | 93 | 95 |
| 623877 | 59 | 76 | 92 | 97 | 96 |
| 623878 | 50 | 73 | 90 | 94 | 95 |

TABLE 44

| ISIS No | 0.938 µM | 1.875 µM | 3.750 µM | 7.500 µM | 15.00 µM |
|---|---|---|---|---|---|
| 613412 | 8 | 25 | 58 | 77 | 87 |
| 620887 | 49 | 77 | 87 | 95 | 86 |
| 621360 | 27 | 46 | 68 | 83 | 90 |
| 621361 | 52 | 73 | 89 | 92 | 94 |
| 621363 | 28 | 45 | 71 | 76 | 77 |
| 621364 | 39 | 58 | 77 | 90 | 95 |
| 621407 | 38 | 60 | 75 | 82 | 78 |
| 621414 | 41 | 66 | 80 | 90 | 83 |
| 621424 | 54 | 72 | 87 | 94 | 90 |
| 621425 | 8 | 22 | 52 | 74 | 84 |
| 621426 | 33 | 46 | 63 | 84 | 91 |
| 621740 | 0 | 1 | 6 | 33 | 65 |
| 621793 | 4 | 15 | 30 | 41 | 52 |
| 621794 | 29 | 38 | 57 | 78 | 85 |
| 621810 | 15 | 39 | 45 | 73 | 79 |

TABLE 45

| ISIS No | 0.938 µM | 1.875 µM | 3.750 µM | 7.500 µM | 15.00 µM |
|---|---|---|---|---|---|
| 613412 | 40 | 72 | 78 | 92 | 94 |
| 620887 | 58 | 79 | 92 | 96 | 97 |
| 621431 | 62 | 63 | 79 | 85 | 87 |
| 621441 | 71 | 80 | 84 | 95 | 95 |
| 621446 | 53 | 70 | 82 | 89 | 94 |
| 621448 | 46 | 60 | 85 | 89 | 93 |
| 621454 | 63 | 70 | 81 | 89 | 94 |
| 621484 | 60 | 65 | 75 | 88 | 93 |
| 621570 | 26 | 55 | 81 | 79 | 90 |
| 621576 | 23 | 34 | 71 | 75 | 80 |
| 621578 | 30 | 45 | 67 | 81 | 90 |
| 621579 | 14 | 28 | 49 | 69 | 88 |
| 621598 | 38 | 55 | 73 | 88 | 94 |
| 621670 | 37 | 57 | 79 | 82 | 92 |
| 621675 | 31 | 35 | 51 | 79 | 87 |

TABLE 46

| ISIS No | 0.938 µM | 1.875 µM | 3.750 µM | 7.500 µM | 15.00 µM |
|---|---|---|---|---|---|
| 613412 | 21 | 38 | 70 | 84 | 92 |
| 620887 | 50 | 63 | 83 | 91 | 96 |
| 621894 | 35 | 16 | 32 | 54 | 70 |
| 621895 | 23 | 48 | 61 | 82 | 89 |
| 621961 | 8 | 14 | 47 | 57 | 75 |
| 621983 | 33 | 52 | 63 | 72 | 83 |
| 621991 | 36 | 56 | 68 | 86 | 92 |
| 622001 | 8 | 33 | 60 | 77 | 90 |
| 622080 | 29 | 53 | 69 | 67 | 93 |
| 622088 | 20 | 45 | 66 | 84 | 91 |
| 622091 | 14 | 33 | 47 | 70 | 82 |
| 622110 | 25 | 24 | 64 | 80 | 90 |
| 622111 | 17 | 41 | 74 | 86 | 92 |
| 623747 | 12 | 47 | 53 | 82 | 87 |

TABLE 47

| ISIS No | 0.938 µM | 1.875 µM | 3.750 µM | 7.500 µM | 15.00 µM |
|---|---|---|---|---|---|
| 613412 | 22 | 34 | 49 | 77 | 77 |
| 620887 | 51 | 68 | 83 | 94 | 95 |
| 623672 | 33 | 43 | 64 | 82 | 88 |
| 623697 | 37 | 53 | 59 | 80 | 90 |
| 623698 | 32 | 57 | 63 | 84 | 92 |
| 623708 | 47 | 68 | 82 | 88 | 95 |
| 623709 | 14 | 37 | 62 | 76 | 89 |
| 623712 | 22 | 45 | 70 | 86 | 92 |
| 623732 | 18 | 37 | 54 | 76 | 87 |
| 623756 | 23 | 38 | 68 | 86 | 94 |
| 623782 | 50 | 72 | 83 | 90 | 93 |
| 623791 | 58 | 71 | 87 | 93 | 95 |
| 623796 | 44 | 57 | 74 | 79 | 85 |
| 623808 | 30 | 55 | 73 | 84 | 91 |
| 623809 | 31 | 42 | 66 | 82 | 93 |

Example 12

Antisense Inhibition of Human Tau in HepG2 Cells by 5-10-5 MOE, 5-8-5 MOE, 4-8-6 MOE, or 6-8-4 MOE Gapmers Antisense oligonucleotides were designed targeting a tau nucleic acid and were tested for their effects on tau mRNA in vitro. The antisense oligonucleotides were tested in a series of experiments that had similar culture conditions. ISIS 613412 was also included in the assays. The results for each experiment are presented in separate tables shown below. Cultured HepG2 cells at a density of 20,000 cells per well were transfected using electroporation with 8,000 nM antisense oligonucleotide. After a treatment period of approximately 24 hours, RNA was isolated from the cells and tau mRNA levels were measured by quantitative real-time PCR. Human primer probe set RTS3104 was used to measure mRNA levels. Tau mRNA levels were adjusted according to total RNA content, as measured by RIBOGREEN®. Results are presented as percent inhibition of tau, relative to untreated control cells.

The newly designed chimeric antisense oligonucleotides in the Tables below were designed as 5-8-5 MOE, 4-8-6 MOE, or 6-8-4 MOE gapmers. The 5-8-5 MOE gapmers are 18 nucleosides in length, wherein the central gap segment comprises of eight 2'-deoxynucleosides and is flanked by wing segments on the 5' direction and the 3' direction comprising five nucleosides each. The 4-8-6 MOE gapmers are 18 nucleosides in length, wherein the central gap segment comprises of eight 2'-deoxynucleosides and is flanked by wing segments on the 5' direction and the 3' direction comprising four and six nucleosides respectively. The 6-8-4 MOE gapmers are 18 nucleosides in length, wherein the central gap segment comprises of eight 2'-deoxynucleosides and is flanked by wing segments on the 5' direction and the 3' direction comprising six and four nucleosides respectively. Each nucleoside in the 5' wing segment and each nucleoside in the 3' wing segment has a 2'-MOE modification. The internucleoside linkage motif throughout for each gapmer in the tables below, except for ISIS 613412, is 5'-sooosssssssssooss-3', wherein each "s" represents a phosphorothioate internucleoside linkage and wherein each "o" represents a phosphodiester internucleoside linkage. The internucleoside linkage motif for ISIS 613412 is 5'-soooosssssssssooss-3', wherein each "s" represents a phosphorothioate internucleoside linkage and wherein each "o" represents a phosphodiester internucleoside linkage. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to human tau genomic sequence, designated herein as SEQ ID NO: 1 (GENBANK Accession No. NT_010783.15 truncated from nucleotides 9240000 to 9381000).

TABLE 48

Inhibition of tau mRNA by 5-10-5 MOE gapmers targeting SEQ ID NO: 1

| ISIS NO | SEQ ID NO: 1 Start Site | SEQ ID NO: 1 Stop Site | Sequence | Motif | % inhibition | SEQ ID NO |
|---|---|---|---|---|---|---|
| 613412 | 73879 | 73898 | GTGATCTTCCATCACTTCGA | 5-10-5 | 90 | 25 |
| 620887 | 98891 98928 | 98908 98945 | GTTTTCAAACACACCTTC | 5-10-5 | 93 | 665 |
| 623888 | 20951 | 20968 | TTCGATTTGTTATTGGGA | 5-10-5 | 79 | 2201 |
| 623889 | 20953 | 20970 | ACTTCGATTTGTTATTGG | 5-10-5 | 61 | 2202 |
| 623890 | 20954 | 20971 | GACTTCGATTTGTTATTG | 5-10-5 | 30 | 2203 |
| 623891 | 20955 | 20972 | TGACTTCGATTTGTTATT | 5-10-5 | 62 | 2204 |
| 623892 | 20956 | 20973 | CTGACTTCGATTTGTTAT | 5-10-5 | 60 | 2205 |
| 623893 | 20957 | 20974 | GCTGACTTCGATTTGTTA | 5-10-5 | 43 | 2206 |
| 623894 | 20958 | 20975 | AGCTGACTTCGATTTGTT | 5-10-5 | 83 | 2207 |
| 623895 | 20959 | 20976 | CAGCTGACTTCGATTTGT | 5-10-5 | 68 | 2208 |
| 623896 | 20961 | 20978 | CCCAGCTGACTTCGATTT | 5-10-5 | 11 | 2209 |
| 623897 | 20964 | 20981 | ACGCCCAGCTGACTTCGA | 5-10-5 | 65 | 2210 |
| 623898 | 27148 | 27165 | TGCCTTATATATGCTGAA | 5-10-5 | 82 | 2211 |
| 623899 | 27153 | 27170 | TTACATGCCTTATATATG | 5-10-5 | 31 | 2212 |
| 623900 | 27156 | 27173 | CAGTTACATGCCTTATAT | 5-10-5 | 33 | 2213 |
| 623901 | 27158 | 27175 | TTCAGTTACATGCCTTAT | 5-10-5 | 72 | 2214 |
| 623902 | 27159 | 27176 | GTTCAGTTACATGCCTTA | 5-10-5 | 92 | 2215 |
| 623903 | 27169 | 27186 | AAAGTGCTGTGTTCAGTT | 5-10-5 | 71 | 2216 |
| 623904 | 27174 | 27191 | CCTCTAAAGTGCTGTGTT | 5-10-5 | 35 | 2217 |
| 623905 | 28215 | 28232 | GACTTTCTCAATGTAAC | 5-10-5 | 43 | 2218 |
| 623906 | 28220 | 28237 | CTGCAGACTTTTCTCAAT | 5-10-5 | 61 | 2219 |
| 623907 | 28226 | 28243 | ACCTCTCTGCAGACTTTT | 5-10-5 | 79 | 2220 |
| 623908 | 28227 | 28244 | CACCTCTCTGCAGACTTT | 5-10-5 | 81 | 2221 |
| 623909 | 28228 | 28245 | GCACCTCTCTGCAGACTT | 5-10-5 | 82 | 2222 |
| 623910 | 28229 | 28246 | GGCACCTCTCTGCAGACT | 5-10-5 | 81 | 2223 |
| 623911 | 28230 | 28247 | TGGCACCTCTCTGCAGAC | 5-10-5 | 36 | 2224 |
| 623912 | 28231 | 28248 | CTGGCACCTCTCTGCAGA | 5-10-5 | 11 | 2225 |
| 623913 | 28233 | 28250 | TGCTGGCACCTCTCTGCA | 5-10-5 | 51 | 2226 |
| 623914 | 28236 | 28253 | TGATGCTGGCACCTCTCT | 5-10-5 | 63 | 2227 |
| 623915 | 28241 | 28258 | CCTTGTGATGCTGGCACC | 5-10-5 | 79 | 2228 |
| 623916 | 75133 | 75150 | TTTTTAGCATTAAAAGAG | 5-10-5 | 0 | 2229 |
| 623917 | 75144 | 75161 | GTGTTTTCTTATTTTTAG | 5-10-5 | 80 | 2230 |

TABLE 48-continued

Inhibition of tau mRNA by 5-10-5 MOE gapmers targeting SEQ ID NO: 1

| ISIS NO | SEQ ID NO: 1 Start Site | SEQ ID NO: 1 Stop Site | Sequence | Motif | % inhibition | SEQ ID NO |
|---|---|---|---|---|---|---|
| 623918 | 75149 | 75166 | GCAAGGTGTTTTCTTATT | 5-10-5 | 55 | 2231 |
| 623919 | 86762 | 86779 | TAGGCCTCTTCTGCATTT | 5-10-5 | 27 | 2232 |
| 623920 | 86767 | 86784 | CTGGCTAGGCCTCTTCTG | 5-10-5 | 54 | 2233 |
| 623921 | 86770 | 86787 | ATCCTGGCTAGGCCTCTT | 5-10-5 | 69 | 2234 |
| 623922 | 86772 | 86789 | AAATCCTGGCTAGGCCTC | 5-10-5 | 67 | 2235 |
| 623923 | 86773 | 86790 | GAAATCCTGGCTAGGCCT | 5-10-5 | 55 | 2236 |
| 623924 | 86774 | 86791 | TGAAATCCTGGCTAGGCC | 5-10-5 | 64 | 2237 |
| 623925 | 86775 | 86792 | GTGAAATCCTGGCTAGGC | 5-10-5 | 77 | 2238 |
| 623926 | 86776 | 86793 | GGTGAAATCCTGGCTAGG | 5-10-5 | 57 | 2239 |
| 623927 | 86777 | 86794 | TGGTGAAATCCTGGCTAG | 5-10-5 | 8 | 2240 |
| 623928 | 86778 | 86795 | CTGGTGAAATCCTGGCTA | 5-10-5 | 45 | 2241 |
| 623929 | 86780 | 86797 | TGCTGGTGAAATCCTGGC | 5-10-5 | 63 | 2242 |
| 623930 | 86783 | 86800 | CACTGCTGGTGAAATCCT | 5-10-5 | 70 | 2243 |
| 623931 | 121716 | 121733 | ACCCTGGACCCGCCTACT | 5-10-5 | 49 | 2244 |
| 623932 | 121721 | 121738 | GCGCCACCCTGGACCCGC | 5-10-5 | 84 | 2245 |
| 623933 | 121724 | 121741 | CATGCGCCACCCTGGACC | 5-10-5 | 52 | 2246 |
| 623934 | 121726 | 121743 | GACATGCGCCACCCTGGA | 5-10-5 | 80 | 2247 |
| 623935 | 121727 | 121744 | TGACATGCGCCACCCTGG | 5-10-5 | 74 | 2248 |
| 623936 | 121728 | 121745 | GTGACATGCGCCACCCTG | 5-10-5 | 90 | 2249 |
| 623937 | 121729 | 121746 | AGTGACATGCGCCACCCT | 5-10-5 | 84 | 2250 |
| 623938 | 121730 | 121747 | GAGTGACATGCGCCACCC | 5-10-5 | 92 | 2251 |
| 623939 | 121731 | 121748 | TGAGTGACATGCGCCACC | 5-10-5 | 86 | 2252 |
| 623940 | 121732 | 121749 | ATGAGTGACATGCGCCAC | 5-10-5 | 64 | 2253 |
| 623941 | 121734 | 121751 | CGATGAGTGACATGCGCC | 5-10-5 | 76 | 2254 |
| 623942 | 121737 | 121754 | TTTCGATGAGTGACATGC | 5-10-5 | 60 | 2255 |
| 623943 | 121742 | 121759 | TCCACTTTCGATGAGTGA | 5-10-5 | 34 | 2256 |
| 623944 | 121938 | 121955 | CAGCACGGCGCATGGGAC | 5-10-5 | 26 | 2257 |
| 623945 | 121939 | 121956 | ACAGCACGGCGCATGGGA | 5-10-5 | 62 | 2258 |
| 623946 | 121940 | 121957 | CACAGCACGGCGCATGGG | 5-10-5 | 57 | 2259 |
| 621455 | 121941 | 121958 | CCACAGCACGGCGCATGG | 5-10-5 | 44 | 1232 |
| 623804 | 121942 | 121959 | GCCACAGCACGGCGCATG | 5-10-5 | 85 | 1657 |
| 623947 | 121943 | 121960 | AGCCACAGCACGGCGCAT | 5-10-5 | 83 | 2260 |
| 623948 | 121944 | 121961 | AAGCCACAGCACGGCGCA | 5-10-5 | 56 | 2261 |
| 623949 | 121946 | 121963 | TCAAGCCACAGCACGGCG | 5-10-5 | 58 | 2262 |
| 623950 | 121949 | 121966 | AATTCAAGCCACAGCACG | 5-10-5 | 52 | 2263 |
| 623951 | 121954 | 121971 | CTAATAATTCAAGCCACA | 5-10-5 | 56 | 2264 |

TABLE 48-continued

Inhibition of tau mRNA by 5-10-5 MOE gapmers targeting SEQ ID NO: 1

| ISIS NO | SEQ ID NO: 1 Start Site | SEQ ID NO: 1 Stop Site | Sequence | Motif | % inhibition | SEQ ID NO |
|---|---|---|---|---|---|---|
| 623952 | 125424 | 125441 | GACATTTGCTCAGCAAAC | 5-10-5 | 74 | 2265 |
| 623953 | 125426 | 125443 | CAGACATTTGCTCAGCAA | 5-10-5 | 62 | 2266 |
| 623954 | 125427 | 125444 | CCAGACATTTGCTCAGCA | 5-10-5 | 75 | 2267 |
| 623955 | 125428 | 125445 | CCCAGACATTTGCTCAGC | 5-10-5 | 65 | 2268 |
| 623956 | 125429 | 125446 | ACCCAGACATTTGCTCAG | 5-10-5 | 30 | 2269 |
| 623957 | 125430 | 125447 | GACCCAGACATTTGCTCA | 5-10-5 | 30 | 2270 |
| 623958 | 125431 | 125448 | AGACCCAGACATTTGCTC | 5-10-5 | 41 | 2271 |
| 623959 | 125432 | 125449 | AAGACCCAGACATTTGCT | 5-10-5 | 69 | 2272 |
| 623960 | 125434 | 125451 | GCAAGACCCAGACATTTG | 5-10-5 | 73 | 2273 |
| 623961 | 125437 | 125454 | TGTGCAAGACCCAGACAT | 5-10-5 | 62 | 2274 |
| 623962 | 125442 | 125459 | GTCATTGTGCAAGACCCA | 5-10-5 | 87 | 2275 |

TABLE 49

Inhibition of tau mRNA by 5-10-5 MOE, 5-8-5 MOE, 4-8-6 MOE, and 6-8-4 gapmers targeting SEQ ID NO: 1

| ISIS NO | SEQ ID NO: 1 Start Site | SEQ ID NO: 1 Stop Site | Sequence | Motif | % inhibition | SEQ ID NO |
|---|---|---|---|---|---|---|
| 613412 | 73879 | 73898 | GTGATCTTCCATCACTTCGA | 5-10-5 | 87 | 25 |
| 620887 | 98891 98928 | 98908 98945 | GTTTTCAAACACACCTTC | 5-8-5 | 96 | 665 |
| 620888 | 98881 98918 | 98898 98935 | ACACCTTCATTTACTGTC | 5-8-5 | 96 | 897 |
| 620889 | 98890 98927 | 98907 98944 | TTTTCAAACACACCTTCA | 5-8-5 | 85 | 898 |
| 620890 | 98892 98929 | 98909 98946 | GGTTTTCAAACACACCTT | 5-8-5 | 95 | 899 |
| 620891 | 98893 98930 | 98910 98947 | TGGTTTTCAAACACACCT | 5-8-5 | 96 | 900 |
| 623963 | 73877 | 73894 | TCTTCCATCACTTCGAAC | 5-8-5 | 58 | 2276 |
| 623964 | 73878 | 73895 | ATCTTCCATCACTTCGAA | 5-8-5 | 44 | 2277 |
| 623965 | 73880 | 73897 | TGATCTTCCATCACTTCG | 5-8-5 | 51 | 2278 |
| 623966 | 73881 | 73898 | GTGATCTTCCATCACTTC | 5-8-5 | 45 | 2279 |
| 623967 | 73931 | 73948 | ATGGTGTAGCCCCCCTGA | 5-8-5 | 66 | 2280 |
| 623968 | 73932 | 73949 | CATGGTGTAGCCCCCCTG | 5-8-5 | 87 | 2281 |
| 623969 | 73934 | 73951 | TGCATGGTGTAGCCCCCC | 5-8-5 | 94 | 2282 |
| 623970 | 73935 | 73952 | GTGCATGGTGTAGCCCCC | 5-8-5 | 90 | 2283 |
| 623971 | 73957 | 73974 | CCGTGTCACCCTCTTGGT | 5-8-5 | 83 | 2284 |

TABLE 49-continued

Inhibition of tau mRNA by 5-10-5 MOE, 5-8-5 MOE, 4-8-6 MOE, and 6-8-4 gapmers targeting SEQ ID NO: 1

| ISIS NO | SEQ ID NO: 1 Start Site | SEQ ID NO: 1 Stop Site | Sequence | Motif | % inhibition | SEQ ID NO |
|---|---|---|---|---|---|---|
| 623972 | 73958 | 73975 | TCCGTGTCACCCTCTTGG | 5-8-5 | 79 | 2285 |
| 623973 | 73960 | 73977 | CGTCCGTGTCACCCTCTT | 5-8-5 | 92 | 2286 |
| 623974 | 83429 | 83446 | TCTTAGCATCAGAGGTTT | 5-8-5 | 70 | 2287 |
| 623975 | 83430 | 83447 | CTCTTAGCATCAGAGGTT | 5-8-5 | 76 | 2288 |
| 623976 | 83432 | 83449 | TGCTCTTAGCATCAGAGG | 5-8-5 | 72 | 2289 |
| 623977 | 83433 | 83450 | GTGCTCTTAGCATCAGAG | 5-8-5 | 86 | 2290 |
| 623978 | 95266 | 95283 | CTCCTCCGAGTGCGCCTG | 5-8-5 | 24 | 2291 |
| 623979 | 95267 | 95284 | GCTCCTCCGAGTGCGCCT | 5-8-5 | 77 | 2292 |
| 623980 | 95269 | 95286 | ATGCTCCTCCGAGTGCGC | 5-8-5 | 58 | 2293 |
| 623981 | 95270 | 95287 | AATGCTCCTCCGAGTGCG | 5-8-5 | 79 | 2294 |
| 623982 | 95272 | 95289 | CAAATGCTCCTCCGAGTG | 5-8-5 | 34 | 2295 |
| 623983 | 98557 | 98574 | TTACTGACCATGCGAGCT | 5-8-5 | 79 | 2296 |
| 623984 | 98558 | 98575 | TTTACTGACCATGCGAGC | 5-8-5 | 73 | 2297 |
| 623985 | 98560 | 98577 | CTTTTACTGACCATGCGA | 5-8-5 | 85 | 2298 |
| 623986 | 98561 | 98578 | GCTTTTACTGACCATGCG | 5-8-5 | 91 | 2299 |
| 623987 | 98563 | 98580 | TTGCTTTTACTGACCATG | 5-8-5 | 96 | 2300 |
| 623988 | 135784 | 135801 | ACTGCGAGGAGCAGCTGG | 5-8-5 | 43 | 2301 |
| 623989 | 135785 | 135802 | AACTGCGAGGAGCAGCTG | 5-8-5 | 31 | 2302 |
| 623990 | 135787 | 135804 | CGAACTGCGAGGAGCAGC | 5-8-5 | 62 | 2303 |
| 623991 | 135788 | 135805 | CCGAACTGCGAGGAGCAG | 5-8-5 | 73 | 2304 |
| 623992 | 135790 | 135807 | AACCGAACTGCGAGGAGC | 5-8-5 | 73 | 2305 |
| 623993 | 135868 | 135885 | TGCTCTTACTCCCATCAC | 5-8-5 | 59 | 2306 |
| 623994 | 135869 | 135886 | TTGCTCTTACTCCCATCA | 5-8-5 | 85 | 2307 |
| 623995 | 135871 | 135888 | ATTTGCTCTTACTCCCAT | 5-8-5 | 77 | 2308 |
| 623996 | 135872 | 135889 | AATTTGCTCTTACTCCCA | 5-8-5 | 80 | 2309 |
| 625423 | 98879 | 98896 | ACCTTCATTTACTGTCAG | 5-8-5 | 90 | 2310 |
| 625424 | 98880 | 98897 | CACCTTCATTTACTGTCA | 5-8-5 | 94 | 2311 |
| 625425 | 98882 98919 | 98899 98936 | CACACCTTCATTTACTGT | 5-8-5 5-8-5 | 89 | 2312 |
| 625426 | 98883 98920 | 98900 98937 | ACACACCTTCATTTACTG | 5-8-5 | 87 | 2313 |
| 625427 | 98884 98921 | 98901 98938 | AACACACCTTCATTTACT | 5-8-5 | 86 | 2314 |
| 625428 | 98885 98922 | 98902 98939 | AAACACACCTTCATTTAC | 5-8-5 | 49 | 2315 |
| 625429 | 98886 98923 | 98903 98940 | CAAACACACCTTCATTTA | 5-8-5 | 66 | 2316 |
| 625430 | 98887 98924 | 98904 98941 | TCAAACACACCTTCATTT | 5-8-5 | 70 | 2317 |

TABLE 49-continued

Inhibition of tau mRNA by 5-10-5 MOE, 5-8-5 MOE, 4-8-6 MOE, and 6-8-4 gapmers targeting SEQ ID NO: 1

| ISIS NO | SEQ ID NO: 1 Start Site | SEQ ID NO: 1 Stop Site | Sequence | Motif | % inhibition | SEQ ID NO |
|---|---|---|---|---|---|---|
| 625431 | 98888 98925 | 98905 98942 | TTCAAACACACCTTCATT | 5-8-5 | 74 | 2318 |
| 625432 | 98889 98926 | 98906 98943 | TTTCAAACACACCTTCAT | 5-8-5 | 81 | 2319 |
| 625433 | 98894 | 98911 | TTGGTTTTCAAACACACC | 5-8-5 | 92 | 2320 |
| 625434 | 75128 | 75145 | AGCATTAAAAGAGAAAAG | 5-8-5 | 13 | 2321 |
| 625435 | 75136 | 75153 | TTATTTTTAGCATTAAAA | 5-8-5 | 0 | 2322 |
| 625436 | 75138 | 75155 | TCTTATTTTTAGCATTAA | 5-8-5 | 52 | 2323 |
| 625437 | 75139 | 75156 | TTCTTATTTTTAGCATTA | 5-8-5 | 86 | 2324 |
| 625438 | 75140 | 75157 | TTTCTTATTTTTAGCATT | 5-8-5 | 40 | 2325 |
| 625439 | 75141 | 75158 | TTTTCTTATTTTTAGCAT | 5-8-5 | 0 | 2326 |
| 625440 | 75142 | 75159 | GTTTTCTTATTTTTAGCA | 5-8-5 | 82 | 2327 |
| 625441 | 75143 | 75160 | TGTTTTCTTATTTTTAGC | 5-8-5 | 68 | 2328 |
| 625442 | 75146 | 75163 | AGGTGTTTTCTTATTTTT | 5-8-5 | 83 | 2329 |
| 625443 | 75154 | 75171 | GGGCTGCAAGGTGTTTTC | 5-8-5 | 69 | 2330 |
| 625444 | 98881 98918 | 98898 98935 | ACACCTTCATTTACTGTC | 4-8-6 | 90 | 897 |
| 625445 | 98882 98919 | 98899 98936 | CACACCTTCATTTACTGT | 4-8-6 | 82 | 2312 |
| 625446 | 98883 98920 | 98900 98937 | ACACACCTTCATTTACTG | 4-8-6 | 84 | 2313 |
| 625447 | 98884 98921 | 98901 98938 | AACACACCTTCATTTACT | 4-8-6 | 40 | 2314 |
| 625448 | 98889 98926 | 98906 98943 | TTTCAAACACACCTTCAT | 4-8-6 | 83 | 2319 |
| 625449 | 98890 98927 | 98907 98944 | TTTTCAAACACACCTTCA | 4-8-6 | 0 | 898 |
| 625450 | 98891 98928 | 98908 98945 | GTTTTCAAACACACCTTC | 4-8-6 | 94 | 665 |
| 625451 | 98892 98929 | 98909 98946 | GGTTTTCAAACACACCTT | 4-8-6 | 94 | 899 |
| 625452 | 98893 98930 | 98910 98947 | TGGTTTTCAAACACACCT | 4-8-6 | 94 | 900 |
| 625453 | 98881 98918 | 98898 98935 | ACACCTTCATTTACTGTC | 6-8-4 | 96 | 897 |
| 625454 | 98882 98919 | 98899 98936 | CACACCTTCATTTACTGT | 6-8-4 | 96 | 2312 |
| 625455 | 98883 98920 | 98900 98937 | ACACACCTTCATTTACTG | 6-8-4 | 93 | 2313 |
| 625456 | 98884 98921 | 98901 98938 | AACACACCTTCATTTACT | 6-8-4 | 88 | 2314 |
| 625457 | 98889 98926 | 98906 98943 | TTTCAAACACACCTTCAT | 6-8-4 | 85 | 2319 |
| 625458 | 98890 98927 | 98907 98944 | TTTTCAAACACACCTTCA | 6-8-4 | 90 | 898 |

TABLE 49-continued

Inhibition of tau mRNA by 5-10-5 MOE, 5-8-5 MOE, 4-8-6 MOE, and 6-8-4 gapmers targeting SEQ ID NO: 1

| ISIS NO | SEQ ID NO: 1 Start Site | SEQ ID NO: 1 Stop Site | Sequence | Motif | % inhibition | SEQ ID NO |
|---|---|---|---|---|---|---|
| 625459 | 98891 98928 | 98908 98945 | GTTTTCAAACACACCTTC | 6-8-4 | 97 | 665 |
| 625460 | 98892 98929 | 98909 98946 | GGTTTTCAAACACACCTT | 6-8-4 | 97 | 899 |
| 625461 | 98893 98930 | 98910 98947 | TGGTTTTCAAACACACCT | 6-8-4 | 96 | 900 |

Example 13

Dose-Dependent Antisense Inhibition of Human Tau in SH-SY5Y Cells by MOE Gapmers Gapmers from studies described above exhibiting significant in vitro inhibition of tau mRNA were selected and tested at various doses in SH-SY5Y cells. The antisense oligonucleotides were tested in a series of experiments that had similar culture conditions. The results for each experiment are presented in separate tables shown below. Cells were plated at a density of 20,000 cells per well and transfected using electroporation with 0.938 µM, 0.1.875 µM, 3.750 µM, 7.500 µM, and 15.00 µM concentrations of antisense oligonucleotide, as specified in the Tables below. After a treatment period of approximately 16 hours, RNA was isolated from the cells and tau mRNA levels were measured by quantitative real-time PCR. Human primer probe set RTS3104 was used to measure mRNA levels. Tau mRNA levels were adjusted according to total RNA content, as measured by RIBOGREEN®. Results are presented as percent inhibition of tau, relative to untreated control cells. Tau mRNA levels were significantly reduced in a dose-dependent manner in antisense oligonucleotide treated cells.

TABLE 50

| ISIS No | 0.938 µM | 1.875 µM | 3.750 µM | 7.500 µM | 15.00 µM |
|---|---|---|---|---|---|
| 613412 | 57 | 53 | 49 | 83 | 91 |
| 620887 | 68 | 84 | 95 | 95 | 97 |
| 620919 | 35 | 54 | 76 | 95 | 96 |
| 620930 | 32 | 49 | 76 | 86 | 92 |
| 620946 | 41 | 61 | 73 | 90 | 92 |
| 620971 | 61 | 63 | 75 | 88 | 96 |
| 620976 | 40 | 68 | 80 | 91 | 96 |
| 620978 | 49 | 49 | 78 | 93 | 94 |
| 620988 | 64 | 58 | 76 | 92 | 95 |
| 621031 | 51 | 72 | 90 | 89 | 92 |
| 621032 | 35 | 55 | 81 | 89 | 96 |
| 621041 | 48 | 73 | 80 | 88 | 95 |
| 621236 | 62 | 59 | 78 | 86 | 88 |
| 621239 | 46 | 62 | 63 | 94 | 94 |
| 621254 | 63 | 67 | 88 | 84 | 87 |

TABLE 51

| ISIS No | 0.938 µM | 1.875 µM | 3.750 µM | 7.500 µM | 15.00 µM |
|---|---|---|---|---|---|
| 613412 | 33 | 54 | 63 | 89 | 95 |
| 620887 | 72 | 90 | 95 | 96 | 96 |

TABLE 51-continued

| ISIS No | 0.938 µM | 1.875 µM | 3.750 µM | 7.500 µM | 15.00 µM |
|---|---|---|---|---|---|
| 620889 | 20 | 45 | 72 | 87 | 95 |
| 621417 | 52 | 68 | 81 | 88 | 92 |
| 621434 | 45 | 64 | 69 | 84 | 76 |
| 621440 | 58 | 72 | 77 | 88 | 87 |
| 621492 | 40 | 60 | 80 | 78 | 83 |
| 621599 | 43 | 73 | 83 | 91 | 95 |
| 621615 | 36 | 67 | 74 | 81 | 87 |
| 621620 | 48 | 74 | 88 | 95 | 98 |
| 621644 | 4 | 28 | 33 | 55 | 65 |
| 623685 | 30 | 48 | 73 | 87 | 93 |
| 623872 | 31 | 61 | 80 | 90 | 94 |
| 623879 | 22 | 50 | 74 | 88 | 95 |
| 623932 | 39 | 62 | 80 | 91 | 95 |

TABLE 52

| ISIS No | 0.938 µM | 1.875 µM | 3.750 µM | 7.500 µM | 15.00 µM |
|---|---|---|---|---|---|
| 613412 | 23 | 51 | 50 | 87 | 94 |
| 620887 | 64 | 82 | 92 | 95 | 96 |
| 620891 | 79 | 89 | 93 | 96 | 96 |
| 623757 | 38 | 58 | 73 | 85 | 95 |
| 623783 | 30 | 40 | 67 | 78 | 91 |
| 623804 | 51 | 70 | 81 | 87 | 92 |
| 623902 | 62 | 77 | 90 | 87 | 95 |
| 623936 | 46 | 70 | 84 | 91 | 94 |
| 623937 | 48 | 58 | 79 | 91 | 93 |
| 623938 | 39 | 63 | 76 | 90 | 93 |
| 623939 | 29 | 57 | 77 | 91 | 93 |
| 623962 | 44 | 68 | 78 | 87 | 91 |
| 625442 | 32 | 57 | 66 | 82 | 88 |
| 625459 | 74 | 87 | 95 | 96 | 98 |
| 625460 | 88 | 94 | 97 | 97 | 98 |

TABLE 53

| ISIS No | 0.938 µM | 1.875 µM | 3.750 µM | 7.500 µM | 15.00 µM |
|---|---|---|---|---|---|
| 613412 | 6 | 11 | 20 | 0 | 35 |
| 620887 | 71 | 86 | 92 | 95 | 96 |
| 620888 | 73 | 89 | 93 | 95 | 96 |
| 620890 | 82 | 90 | 94 | 95 | 96 |
| 623969 | 41 | 62 | 84 | 94 | n.d. |
| 623987 | 46 | 71 | 89 | 96 | 97 |
| 625424 | 50 | 73 | 88 | 94 | 96 |
| 625433 | 64 | 83 | 90 | 95 | 95 |
| 625450 | 69 | 84 | 91 | 96 | 97 |
| 625451 | 85 | 91 | 95 | 93 | 95 |
| 625452 | 67 | 83 | 91 | 93 | 95 |
| 625453 | 72 | 85 | 91 | 94 | 96 |
| 625454 | 73 | 86 | 93 | 95 | 96 |

TABLE 53-continued

| ISIS No | 0.938 μM | 1.875 μM | 3.750 μM | 7.500 μM | 15.00 μM |
|---|---|---|---|---|---|
| 625455 | 44 | 68 | 86 | 92 | 94 |
| 625461 | 75 | 84 | 94 | 95 | 97 |

TABLE 54

| ISIS No | 0.938 μM | 1.875 μM | 3.750 μM | 7.500 μM | 15.00 μM |
|---|---|---|---|---|---|
| 613412 | 11 | 30 | 65 | 82 | 83 |
| 620887 | 59 | 77 | 66 | 95 | 79 |
| 623968 | 43 | 57 | 72 | 86 | 93 |
| 623970 | 29 | 54 | 77 | 88 | 94 |
| 623973 | 48 | 65 | 80 | 93 | 94 |
| 623977 | 38 | 60 | 72 | 82 | 89 |
| 623986 | 45 | 53 | 80 | 91 | 96 |
| 625423 | 43 | 57 | 75 | 77 | 95 |
| 625425 | 39 | 49 | 78 | 88 | 93 |
| 625426 | 15 | 43 | 61 | 82 | 92 |
| 625427 | 16 | 35 | 64 | 81 | 93 |
| 625437 | 30 | 45 | 64 | 84 | 91 |
| 625444 | 28 | 45 | 67 | 84 | 92 |
| 625446 | 16 | 33 | 58 | 76 | 92 |
| 625456 | 27 | 43 | 57 | 86 | 91 |
| 625458 | 19 | 45 | 61 | 85 | 93 |

TABLE 55

| ISIS No | 0.938 μM | 1.875 μM | 3.750 μM | 7.500 μM | 15.00 μM |
|---|---|---|---|---|---|
| 613412 | 0 | 10 | 31 | 71 | 77 |
| 620887 | 33 | 58 | 74 | 82 | 92 |
| 621842 | 7 | 31 | 45 | 72 | 87 |
| 621846 | 0 | 0 | 28 | 62 | 90 |
| 623903 | 0 | 0 | 25 | 71 | 83 |
| 623985 | 0 | 17 | 41 | 74 | 84 |
| 623994 | 19 | 42 | 67 | 81 | 83 |
| 625457 | 0 | 5 | 57 | 69 | 80 |

Example 14

Design of 5-7-6 MOE, 5-8-5 MOE, 5-9-5 MOE, and 5-10-5 MOE Gapmers with Phosphorothioate and Phosphodiester Internucleoside Linkages at a Hot Spot Region of Human Tau Antisense oligonucleotides were designed targeting a tau nucleic acid at a region identified as a 'hotspot' in the studies above.

The newly designed chimeric antisense oligonucleotides in the Table below were designed as 5-7-6 MOE, 5-8-5 MOE, 5-9-5 MOE, or 5-10-5 MOE gapmers. The 5-7-6 MOE gapmers are 18 nucleosides in length, wherein the central gap segment comprises of seven 2'-deoxynucleosides and is flanked by wing segments on the 5' direction and the 3' direction comprising five and six nucleosides respectively. The 5-8-5 MOE gapmers are 18 nucleosides in length, wherein the central gap segment comprises of eight 2'-deoxynucleosides and is flanked by wing segments on the 5' direction and the 3' direction comprising five nucleosides each. The 5-9-5 MOE gapmers are 19 nucleosides in length, wherein the central gap segment comprises of nine 2'-deoxynucleosides and is flanked by wing segments on the 5' direction and the 3' direction comprising five nucleosides each. The 5-10-5 MOE gapmers are 20 nucleosides in length, wherein the central gap segment comprises of ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are either phosphorothioate linkages or phosphodiester linkages. The 'Chemistry' column describes the internucleoside linkages of each oligonucleotide. 's' indicates phosphorothioate linkage and 'o' indicates phosphodiester linkage. All cytosine residues throughout each gapmer are 5-methylcytosines.

"Start site" indicates the 5'-most nucleoside to which the gapmer is targeted in the human gene sequence. "Stop site" indicates the 3'-most nucleoside to which the gapmer is targeted in the human gene sequence. Each gapmer listed in the Table below is targeted to either the human tau genomic sequence, designated herein as SEQ ID NO: 1 (GENBANK Accession No. NT_010783.15 truncated from nucleotides 9240000 to 9381000) or to the human tau mRNA sequence, designated herein as SEQ ID NO: 2 (GENBANK Accession No. NM_001123066.3). 'n/a' indicates that the antisense oligonucleotide does not target that particular gene sequence with 100% complementarity.

TABLE 56

MOE gapmers targeting SEQ ID NOs: 1 and 2

| ISIS NO | SEQ ID NO: 1 Start Site | SEQ ID NO: 1 Stop Site | Sequence | SEQ ID NO: 2 Start Site | SEQ ID NO: 2 Stop Site | Linkage chemistry | Motif | SEQ ID NO |
|---|---|---|---|---|---|---|---|---|
| 664511 | 135820 | 135837 | GACAAAAGCAGGTTAAGT | 2783 | 2800 | sooosssssssssooss | 5-8-5 | 2331 |
| 664714 | 135820 | 135838 | TGACAAAAGCAGGTTAAGT | 2783 | 2801 | sooosssssssssooss | 5-9-5 | 2332 |
| 664661 | 135820 | 135839 | GTGACAAAAGCAGGTTAAGT | 2783 | 2802 | sooossssssssssooss | 5-10-5 | 2333 |
| 664767 | 135820 | 135837 | GACAAAAGCAGGTTAAGT | 2783 | 2800 | sooosssssssooooss | 5-7-6 | 2331 |
| 664512 | 135821 | 135838 | TGACAAAAGCAGGTTAAG | 2784 | 2801 | sooosssssssssooss | 5-8-5 | 2334 |
| 664715 | 135821 | 135839 | GTGACAAAAGCAGGTTAAG | 2784 | 2802 | sooossssssssssooss | 5-9-5 | 2335 |

TABLE 56-continued

MOE gapmers targeting SEQ ID NOs: 1 and 2

| ISIS NO | SEQ ID NO: 1 Start Site | SEQ ID NO: 1 Stop Site | Sequence | SEQ ID NO: 2 Start Site | SEQ ID NO: 2 Stop Site | Linkage chemistry | Motif | SEQ ID NO |
|---|---|---|---|---|---|---|---|---|
| 664662 | 135821 | 135840 | AGTGACAAAAGCAGGTTAAG | 2784 | 2803 | sooossssssssssooss | 5-10-5 | 2336 |
| 664768 | 135821 | 135838 | TGACAAAAGCAGGTTAAG | 2784 | 2801 | sooossssssssooooss | 5-7-6 | 2334 |
| 622109 | 135822 | 135839 | GTGACAAAAGCAGGTTAA | 2785 | 2802 | sooossssssssssooss | 5-8-5 | 2038 |
| 664716 | 135822 | 135840 | AGTGACAAAAGCAGGTTAA | 2785 | 2803 | sooossssssssssooss | 5-9-5 | 2337 |
| 664663 | 135822 | 135841 | GAGTGACAAAAGCAGGTTAA | 2785 | 2804 | sooossssssssssooss | 5-10-5 | 2338 |
| 664769 | 135822 | 135839 | GTGACAAAAGCAGGTTAA | 2785 | 2802 | sooossssssssooooss | 5-7-6 | 2038 |
| 664513 | 135823 | 135840 | AGTGACAAAAGCAGGTTA | 2786 | 2803 | sooossssssssssooss | 5-8-5 | 2339 |
| 664717 | 135823 | 135841 | GAGTGACAAAAGCAGGTTA | 2786 | 2804 | sooossssssssssooss | 5-9-5 | 2340 |
| 664664 | 135823 | 135842 | CGAGTGACAAAAGCAGGTTA | 2786 | 2805 | sooossssssssssooss | 5-10-5 | 2341 |
| 664770 | 135823 | 135840 | AGTGACAAAAGCAGGTTA | 2786 | 2803 | sooossssssssooooss | 5-7-6 | 2339 |
| 664514 | 135824 | 135841 | GAGTGACAAAAGCAGGTT | 2787 | 2804 | sooossssssssssooss | 5-8-5 | 2342 |
| 664718 | 135824 | 135842 | CGAGTGACAAAAGCAGGTT | 2787 | 2805 | sooossssssssssooss | 5-9-5 | 2343 |
| 664665 | 135824 | 135843 | CCGAGTGACAAAAGCAGGTT | 2787 | 2806 | sooossssssssssooss | 5-10-5 | 2344 |
| 664771 | 135824 | 135841 | GAGTGACAAAAGCAGGTT | 2787 | 2804 | sooossssssssooooss | 5-7-6 | 2342 |
| 622110 | 135825 | 135842 | CGAGTGACAAAAGCAGGT | 2788 | 2805 | sooossssssssssooss | 5-8-5 | 2039 |
| 664719 | 135825 | 135843 | CCGAGTGACAAAAGCAGGT | 2788 | 2806 | sooossssssssssooss | 5-9-5 | 2345 |
| 664666 | 135825 | 135844 | GCCGAGTGACAAAAGCAGGT | 2788 | 2807 | sooossssssssssooss | 5-10-5 | 2346 |
| 664772 | 135825 | 135842 | CGAGTGACAAAAGCAGGT | 2788 | 2805 | sooossssssssooooss | 5-7-6 | 2039 |
| 664515 | 135826 | 135843 | CCGAGTGACAAAAGCAGG | 2789 | 2806 | sooossssssssssooss | 5-8-5 | 2347 |
| 664720 | 135826 | 135844 | GCCGAGTGACAAAAGCAGG | 2789 | 2807 | sooossssssssssooss | 5-9-5 | 2348 |
| 664667 | 135826 | 135845 | AGCCGAGTGACAAAAGCAGG | 2789 | 2808 | sooossssssssssooss | 5-10-5 | 2349 |
| 664773 | 135826 | 135843 | CCGAGTGACAAAAGCAGG | 2789 | 2806 | sooossssssssooooss | 5-7-6 | 2347 |
| 664516 | 135827 | 135844 | GCCGAGTGACAAAAGCAG | 2790 | 2807 | sooossssssssssooss | 5-8-5 | 2350 |
| 664721 | 135827 | 135845 | AGCCGAGTGACAAAAGCAG | 2790 | 2808 | sooossssssssssooss | 5-9-5 | 2351 |
| 664668 | 135827 | 135846 | AAGCCGAGTGACAAAAGCAG | 2790 | 2809 | sooossssssssssooss | 5-10-5 | 2352 |
| 664774 | 135827 | 135844 | GCCGAGTGACAAAAGCAG | 2790 | 2807 | sooossssssssooooss | 5-7-6 | 2350 |
| 622111 | 135828 | 135845 | AGCCGAGTGACAAAAGCA | 2791 | 2808 | sooossssssssssooss | 5-8-5 | 2040 |
| 664722 | 135828 | 135846 | AAGCCGAGTGACAAAAGCA | 2791 | 2809 | sooossssssssssooss | 5-9-5 | 2353 |
| 664669 | 135828 | 135847 | AAAGCCGAGTGACAAAAGCA | 2791 | 2810 | sooossssssssssooss | 5-10-5 | 2354 |
| 664775 | 135828 | 135845 | AGCCGAGTGACAAAAGCA | 2791 | 2808 | sooossssssssooooss | 5-7-6 | 2040 |
| 664517 | 135829 | 135846 | AAGCCGAGTGACAAAAGC | 2792 | 2809 | sooossssssssssooss | 5-8-5 | 2355 |
| 664723 | 135829 | 135847 | AAAGCCGAGTGACAAAAGC | 2792 | 2810 | sooossssssssssooss | 5-9-5 | 2356 |
| 664670 | 135829 | 135848 | CAAAGCCGAGTGACAAAAGC | 2792 | 2811 | sooossssssssssooss | 5-10-5 | 2357 |
| 664776 | 135829 | 135846 | AAGCCGAGTGACAAAAGC | 2792 | 2809 | sooossssssssooooss | 5-7-6 | 2355 |
| 664518 | 135830 | 135847 | AAAGCCGAGTGACAAAAG | 2793 | 2810 | sooossssssssssooss | 5-8-5 | 2358 |
| 664724 | 135830 | 135848 | CAAAGCCGAGTGACAAAAG | 2793 | 2811 | sooossssssssssooss | 5-9-5 | 2359 |

TABLE 56-continued

MOE gapmers targeting SEQ ID NOs: 1 and 2

| ISIS NO | SEQ ID NO: 1 Start Site | SEQ ID NO: 1 Stop Site | Sequence | SEQ ID NO: 2 Start Site | SEQ ID NO: 2 Stop Site | Linkage chemistry | Motif | SEQ ID NO |
|---|---|---|---|---|---|---|---|---|
| 664671 | 135830 | 135849 | CCAAAGCCGAGTGACAAAAG | 2793 | 2812 | sooossssssssssssooss | 5-10-5 | 2360 |
| 664777 | 135830 | 135847 | AAAGCCGAGTGACAAAAG | 2793 | 2810 | sooosssssssssooooss | 5-7-6 | 2358 |
| 622112 | 135831 | 135848 | CAAAGCCGAGTGACAAAA | 2794 | 2811 | sooossssssssssooss | 5-8-5 | 2041 |
| 664725 | 135831 | 135849 | CCAAAGCCGAGTGACAAAA | 2794 | 2812 | sooosssssssssssooss | 5-9-5 | 2361 |
| 664672 | 135831 | 135850 | GCCAAAGCCGAGTGACAAAA | 2794 | 2813 | sooossssssssssssooss | 5-10-5 | 2362 |
| 664778 | 135831 | 135848 | CAAAGCCGAGTGACAAAA | 2794 | 2811 | sooosssssssssooooss | 5-7-6 | 2041 |
| 664519 | 135832 | 135849 | CCAAAGCCGAGTGACAAA | 2795 | 2812 | sooossssssssssooss | 5-8-5 | 2363 |
| 664726 | 135832 | 135850 | GCCAAAGCCGAGTGACAAA | 2795 | 2813 | sooosssssssssssooss | 5-9-5 | 2364 |
| 664673 | 135832 | 135851 | AGCCAAAGCCGAGTGACAAA | 2795 | 2814 | sooossssssssssssooss | 5-10-5 | 2365 |
| 664779 | 135832 | 135849 | CCAAAGCCGAGTGACAAA | 2795 | 2812 | sooosssssssssooooss | 5-7-6 | 2363 |
| 664520 | 135833 | 135850 | GCCAAAGCCGAGTGACAA | 2796 | 2813 | sooossssssssssooss | 5-8-5 | 2366 |
| 664727 | 135833 | 135851 | AGCCAAAGCCGAGTGACAA | 2796 | 2814 | sooosssssssssssooss | 5-9-5 | 2367 |
| 664674 | 135833 | 135852 | GAGCCAAAGCCGAGTGACAA | 2796 | 2815 | sooossssssssssssooss | 5-10-5 | 2368 |
| 664780 | 135833 | 135850 | GCCAAAGCCGAGTGACAA | 2796 | 2813 | sooosssssssssooooss | 5-7-6 | 2366 |
| 622113 | 135834 | 135851 | AGCCAAAGCCGAGTGACA | 2797 | 2814 | sooossssssssssooss | 5-8-5 | 2042 |
| 664728 | 135834 | 135852 | GAGCCAAAGCCGAGTGACA | 2797 | 2815 | sooosssssssssssooss | 5-9-5 | 2369 |
| 664675 | 135834 | 135853 | CGAGCCAAAGCCGAGTGACA | 2797 | 2816 | sooossssssssssssooss | 5-10-5 | 2419 |
| 664781 | 135834 | 135851 | AGCCAAAGCCGAGTGACA | 2797 | 2814 | sooosssssssssooooss | 5-7-6 | 2042 |
| 664521 | 135835 | 135852 | GAGCCAAAGCCGAGTGAC | 2798 | 2815 | sooossssssssssooss | 5-8-5 | 2420 |
| 664729 | 135835 | 135853 | CGAGCCAAAGCCGAGTGAC | 2798 | 2816 | sooosssssssssssooss | 5-9-5 | 2421 |
| 664676 | 135835 | 135854 | CCGAGCCAAAGCCGAGTGAC | 2798 | 2817 | sooossssssssssssooss | 5-10-5 | 2422 |
| 664782 | 135835 | 135852 | GAGCCAAAGCCGAGTGAC | 2798 | 2815 | sooosssssssssooooss | 5-7-6 | 2420 |
| 664522 | 135836 | 135853 | CGAGCCAAAGCCGAGTGA | 2799 | 2816 | sooossssssssssooss | 5-8-5 | 2423 |
| 664730 | 135836 | 135854 | CCGAGCCAAAGCCGAGTGA | 2799 | 2817 | sooosssssssssssooss | 5-9-5 | 2424 |
| 664677 | 135836 | 135855 | CCCGAGCCAAAGCCGAGTGA | 2799 | 2818 | sooossssssssssssooss | 5-10-5 | 2425 |
| 664783 | 135836 | 135853 | CGAGCCAAAGCCGAGTGA | 2799 | 2816 | sooosssssssssooooss | 5-7-6 | 2423 |
| 622114 | 135837 | 135854 | CCGAGCCAAAGCCGAGTG | 2800 | 2817 | sooossssssssssooss | 5-8-5 | 2043 |
| 664731 | 135837 | 135855 | CCCGAGCCAAAGCCGAGTG | 2800 | 2818 | sooosssssssssssooss | 5-9-5 | 2426 |
| 664678 | 135837 | 135856 | TCCCGAGCCAAAGCCGAGTG | 2800 | 2819 | sooossssssssssssooss | 5-10-5 | 2427 |
| 664784 | 135837 | 135854 | CCGAGCCAAAGCCGAGTG | 2800 | 2817 | sooosssssssssooooss | 5-7-6 | 2043 |
| 664523 | 135838 | 135855 | CCCGAGCCAAAGCCGAGT | 2801 | 2818 | sooossssssssssooss | 5-8-5 | 2428 |
| 664732 | 135838 | 135856 | TCCCGAGCCAAAGCCGAGT | 2801 | 2819 | sooosssssssssssooss | 5-9-5 | 2429 |
| 664679 | 135838 | 135857 | GTCCCGAGCCAAAGCCGAGT | 2801 | 2820 | sooossssssssssssooss | 5-10-5 | 2430 |
| 664785 | 135838 | 135855 | CCCGAGCCAAAGCCGAGT | 2801 | 2818 | sooosssssssssooooss | 5-7-6 | 2428 |
| 664524 | 135839 | 135856 | TCCCGAGCCAAAGCCGAG | 2802 | 2819 | sooossssssssssooss | 5-8-5 | 2431 |
| 664733 | 135839 | 135857 | GTCCCGAGCCAAAGCCGAG | 2802 | 2820 | sooosssssssssssooss | 5-9-5 | 2432 |

TABLE 56-continued

MOE gapmers targeting SEQ ID NOs: 1 and 2

| ISIS NO | SEQ ID NO: 1 Start Site | SEQ ID NO: 1 Stop Site | Sequence | SEQ ID NO: 2 Start Site | SEQ ID NO: 2 Stop Site | Linkage chemistry | Motif | SEQ ID NO |
|---|---|---|---|---|---|---|---|---|
| 664680 | 135839 | 135858 | AGTCCCGAGCCAAAGCCGAG | 2802 | 2821 | sooossssssssssssooss | 5-10-5 | 2433 |
| 664786 | 135839 | 135856 | TCCCGAGCCAAAGCCGAG | 2802 | 2819 | sooossssssssooosss | 5-7-6 | 2431 |
| 622115 | 135840 | 135857 | GTCCCGAGCCAAAGCCGA | 2803 | 2820 | sooossssssssssooss | 5-8-5 | 2044 |
| 664734 | 135840 | 135858 | AGTCCCGAGCCAAAGCCGA | 2803 | 2821 | sooossssssssssooss | 5-9-5 | 2434 |
| 664681 | 135840 | 135859 | AAGTCCCGAGCCAAAGCCGA | 2803 | 2822 | sooossssssssssssooss | 5-10-5 | 2435 |
| 664787 | 135840 | 135857 | GTCCCGAGCCAAAGCCGA | 2803 | 2820 | sooossssssssooosss | 5-7-6 | 2044 |
| 664525 | 135841 | 135858 | AGTCCCGAGCCAAAGCCG | 2804 | 2821 | sooossssssssssooss | 5-8-5 | 2436 |
| 664735 | 135841 | 135859 | AAGTCCCGAGCCAAAGCCG | 2804 | 2822 | sooossssssssssooss | 5-9-5 | 2437 |
| 664682 | 135841 | 135860 | GAAGTCCCGAGCCAAAGCCG | 2804 | 2823 | sooossssssssssssooss | 5-10-5 | 2438 |
| 664788 | 135841 | 135858 | AGTCCCGAGCCAAAGCCG | 2804 | 2821 | sooossssssssooosss | 5-7-6 | 2436 |
| 664526 | 135842 | 135859 | AAGTCCCGAGCCAAAGCC | 2805 | 2822 | sooossssssssssooss | 5-8-5 | 2439 |
| 664736 | 135842 | 135860 | GAAGTCCCGAGCCAAAGCC | 2805 | 2823 | sooossssssssssooss | 5-9-5 | 2440 |
| 664683 | 135842 | 135861 | TGAAGTCCCGAGCCAAAGCC | 2805 | 2824 | sooossssssssssssooss | 5-10-5 | 2441 |
| 664789 | 135842 | 135859 | AAGTCCCGAGCCAAAGCC | 2805 | 2822 | sooossssssssooosss | 5-7-6 | 2439 |
| 622116 | 135843 | 135860 | GAAGTCCCGAGCCAAAGC | 2806 | 2823 | sooossssssssssooss | 5-8-5 | 2045 |
| 664737 | 135843 | 135861 | TGAAGTCCCGAGCCAAAGC | 2806 | 2824 | sooossssssssssooss | 5-9-5 | 2442 |
| 664684 | 135843 | 135862 | TTGAAGTCCCGAGCCAAAGC | 2806 | 2825 | sooossssssssssssooss | 5-10-5 | 2443 |
| 664790 | 135843 | 135860 | GAAGTCCCGAGCCAAAGC | 2806 | 2823 | sooossssssssooosss | 5-7-6 | 2045 |
| 664527 | 135844 | 135861 | TGAAGTCCCGAGCCAAAG | 2807 | 2824 | sooossssssssssooss | 5-8-5 | 2478 |
| 664738 | 135844 | 135862 | TTGAAGTCCCGAGCCAAAG | 2807 | 2825 | sooossssssssssooss | 5-9-5 | 2532 |
| 664685 | 135844 | 135863 | TTTGAAGTCCCGAGCCAAAG | 2807 | 2826 | sooossssssssssssooss | 5-10-5 | 2533 |
| 664791 | 135844 | 135861 | TGAAGTCCCGAGCCAAAG | 2807 | 2824 | sooossssssssooosss | 5-7-6 | 2478 |
| 664528 | 135845 | 135862 | TTGAAGTCCCGAGCCAAA | 2808 | 2825 | sooossssssssssooss | 5-8-5 | 2479 |
| 664739 | 135845 | 135863 | TTTGAAGTCCCGAGCCAAA | 2808 | 2826 | sooossssssssssooss | 5-9-5 | 2534 |
| 664686 | 135845 | 135864 | TTTTGAAGTCCCGAGCCAAA | 2808 | 2827 | sooossssssssssssooss | 5-10-5 | 2535 |
| 664792 | 135845 | 135862 | TTGAAGTCCCGAGCCAAA | 2808 | 2825 | sooossssssssooosss | 5-7-6 | 2479 |
| 622117 | 135846 | 135863 | TTTGAAGTCCCGAGCCAA | 2809 | 2826 | sooossssssssssooss | 5-8-5 | 2046 |
| 664740 | 135846 | 135864 | TTTTGAAGTCCCGAGCCAA | 2809 | 2827 | sooossssssssssooss | 5-9-5 | 2536 |
| 664687 | 135846 | 135865 | ATTTTGAAGTCCCGAGCCAA | 2809 | 2828 | sooossssssssssssooss | 5-10-5 | 2537 |
| 664793 | 135846 | 135863 | TTTGAAGTCCCGAGCCAA | 2809 | 2826 | sooossssssssooosss | 5-7-6 | 2538 |
| 664529 | 135847 | 135864 | TTTTGAAGTCCCGAGCCA | 2810 | 2827 | sooossssssssssooss | 5-8-5 | 2480 |
| 664741 | 135847 | 135865 | ATTTTGAAGTCCCGAGCCA | 2810 | 2828 | sooossssssssssooss | 5-9-5 | 2539 |
| 664688 | 135847 | 135866 | GATTTTGAAGTCCCGAGCCA | 2810 | 2829 | sooossssssssssssooss | 5-10-5 | 2540 |
| 664794 | 135847 | 135864 | TTTTGAAGTCCCGAGCCA | 2810 | 2827 | sooossssssssooosss | 5-7-6 | 2480 |
| 664530 | 135848 | 135865 | ATTTTGAAGTCCCGAGCC | 2811 | 2828 | sooossssssssssooss | 5-8-5 | 2481 |
| 664742 | 135848 | 135866 | GATTTTGAAGTCCCGAGCC | 2811 | 2829 | sooossssssssssooss | 5-9-5 | 2541 |

TABLE 56-continued

MOE gapmers targeting SEQ ID NOs: 1 and 2

| ISIS NO | SEQ ID NO: 1 Start Site | SEQ ID NO: 1 Stop Site | Sequence | SEQ ID NO: 2 Start Site | SEQ ID NO: 2 Stop Site | Linkage chemistry | Motif | SEQ ID NO |
|---|---|---|---|---|---|---|---|---|
| 664689 | 135848 | 135867 | TGATTTTGAAGTCCCGAGCC | 1644 | 1663 | sooosssssssssssooss | 5-10-5 | 56 |
| 664795 | 135848 | 135865 | ATTTTGAAGTCCCGAGCC | 2811 | 2828 | sooossssssssooooss | 5-7-6 | 2481 |
| 622118 | 135849 | 135866 | GATTTTGAAGTCCCGAGC | 2812 | 2829 | sooossssssssssooss | 5-8-5 | 2047 |
| 664743 | 135849 | 135867 | TGATTTTGAAGTCCCGAGC | 2812 | 2830 | sooosssssssssssooss | 5-9-5 | 2542 |
| 664690 | 135849 | 135868 | CTGATTTTGAAGTCCCGAGC | 2812 | 2831 | sooossssssssssssooss | 5-10-5 | 464 |
| 664796 | 135849 | 135866 | GATTTTGAAGTCCCGAGC | 2812 | 2829 | sooossssssssoooss | 5-7-6 | 2047 |
| 664531 | 135850 | 135867 | TGATTTTGAAGTCCCGAG | 2813 | 2830 | sooossssssssssooss | 5-8-5 | 2482 |
| 664744 | 135850 | 135868 | CTGATTTTGAAGTCCCGAG | 2813 | 2831 | sooosssssssssssooss | 5-9-5 | 2543 |
| 664691 | 135850 | 135869 | ACTGATTTTGAAGTCCCGAG | 2813 | 2832 | sooossssssssssssooss | 5-10-5 | 2544 |
| 664797 | 135850 | 135867 | TGATTTTGAAGTCCCGAG | 2813 | 2830 | sooossssssssoooss | 5-7-6 | 2482 |
| 664532 | 135851 | 135868 | CTGATTTTGAAGTCCCGA | 2814 | 2831 | sooossssssssssooss | 5-8-5 | 2483 |
| 664745 | 135851 | 135869 | ACTGATTTTGAAGTCCCGA | 2814 | 2832 | sooosssssssssssooss | 5-9-5 | 2545 |
| 664692 | 135851 | 135870 | CACTGATTTTGAAGTCCCGA | 2814 | 2833 | sooossssssssssssooss | 5-10-5 | 2546 |
| 664798 | 135851 | 135868 | CTGATTTTGAAGTCCCGA | 2814 | 2831 | sooossssssssoooss | 5-7-6 | 2483 |
| 622119 | 135852 | 135869 | ACTGATTTTGAAGTCCCG | 2815 | 2832 | sooossssssssssooss | 5-8-5 | 2048 |
| 664746 | 135852 | 135870 | CACTGATTTTGAAGTCCCG | 2815 | 2833 | sooosssssssssssooss | 5-9-5 | 2547 |
| 664693 | 135852 | 135871 | TCACTGATTTTGAAGTCCCG | 2815 | 2834 | sooossssssssssssooss | 5-10-5 | 2548 |
| 664799 | 135852 | 135869 | ACTGATTTTGAAGTCCCG | 2815 | 2832 | sooossssssssoooss | 5-7-6 | 2549 |
| 664533 | 135853 | 135870 | CACTGATTTTGAAGTCCC | 2816 | 2833 | sooossssssssssooss | 5-8-5 | 2370 |
| 664747 | 135853 | 135871 | TCACTGATTTTGAAGTCCC | 2816 | 2834 | sooosssssssssssooss | 5-9-5 | 2371 |
| 664694 | 135853 | 135872 | ATCACTGATTTTGAAGTCCC | 1649 | 1668 | sooossssssssssssooss | 5-10-5 | 57 |
| 664800 | 135853 | 135870 | CACTGATTTTGAAGTCCC | 2816 | 2833 | sooossssssssoooss | 5-7-6 | 2370 |
| 664534 | 135854 | 135871 | TCACTGATTTTGAAGTCC | 2817 | 2834 | sooossssssssssooss | 5-8-5 | 2372 |
| 664748 | 135854 | 135872 | ATCACTGATTTTGAAGTCC | 2817 | 2835 | sooosssssssssssooss | 5-9-5 | 2373 |
| 664695 | 135854 | 135873 | CATCACTGATTTTGAAGTCC | 2817 | 2836 | sooossssssssssssooss | 5-10-5 | 2374 |
| 664801 | 135854 | 135871 | TCACTGATTTTGAAGTCC | 2817 | 2834 | sooossssssssoooss | 5-7-6 | 2372 |
| 622120 | 135855 | 135872 | ATCACTGATTTTGAAGTC | 2818 | 2835 | sooossssssssssooss | 5-8-5 | 1668 |
| 664749 | 135855 | 135873 | CATCACTGATTTTGAAGTC | 2818 | 2836 | sooosssssssssssooss | 5-9-5 | 2375 |
| 664696 | 135855 | 135874 | CCATCACTGATTTTGAAGTC | 2818 | 2837 | sooossssssssssssooss | 5-10-5 | 2376 |
| 664802 | 135855 | 135872 | ATCACTGATTTTGAAGTC | 2818 | 2835 | sooossssssssoooss | 5-7-6 | 1668 |
| 664535 | 135856 | 135873 | CATCACTGATTTTGAAGT | 2819 | 2836 | sooossssssssssooss | 5-8-5 | 2377 |
| 664750 | 135856 | 135874 | CCATCACTGATTTTGAAGT | 2819 | 2837 | sooosssssssssssooss | 5-9-5 | 2378 |
| 664697 | 135856 | 135875 | CCCATCACTGATTTTGAAGT | 2819 | 2838 | sooossssssssssssooss | 5-10-5 | 2379 |
| 664803 | 135856 | 135873 | CATCACTGATTTTGAAGT | 2819 | 2836 | sooossssssssoooss | 5-7-6 | 2377 |
| 664536 | 135857 | 135874 | CCATCACTGATTTTGAAG | 2820 | 2837 | sooossssssssssooss | 5-8-5 | 2380 |
| 664751 | 135857 | 135875 | CCCATCACTGATTTTGAAG | 2820 | 2838 | sooosssssssssssooss | 5-9-5 | 2381 |

TABLE 56-continued

MOE gapmers targeting SEQ ID NOs: 1 and 2

| ISIS NO | SEQ ID NO: 1 Start Site | SEQ ID NO: 1 Stop Site | Sequence | SEQ ID NO: 2 Start Site | SEQ ID NO: 2 Stop Site | Linkage chemistry | Motif | SEQ ID NO |
|---|---|---|---|---|---|---|---|---|
| 664698 | 135857 | 135876 | TCCCATCACTGATTTTGAAG | 2820 | 2839 | sooossssssssssooss | 5-10-5 | 2382 |
| 664804 | 135857 | 135874 | CCATCACTGATTTTGAAG | 2820 | 2837 | sooossssssssooss | 5-7-6 | 2380 |
| 622121 | 135858 | 135875 | CCCATCACTGATTTTGAA | 2821 | 2838 | sooossssssssssooss | 5-8-5 | 1669 |
| 664752 | 135858 | 135876 | TCCCATCACTGATTTTGAA | 2821 | 2839 | sooossssssssssooss | 5-9-5 | 2383 |
| 664699 | 135858 | 135877 | CTCCCATCACTGATTTGAA | 2821 | 2840 | sooossssssssssooss | 5-10-5 | 2384 |
| 664805 | 135858 | 135875 | CCCATCACTGATTTGAA | 2821 | 2838 | sooossssssssooss | 5-7-6 | 1669 |
| 664537 | 135859 | 135876 | TCCCATCACTGATTTTGA | 2822 | 2839 | sooossssssssssooss | 5-8-5 | 2385 |
| 664753 | 135859 | 135877 | CTCCCATCACTGATTTTGA | 2822 | 2840 | sooossssssssssooss | 5-9-5 | 2386 |
| 664700 | 135859 | 135878 | ACTCCCATCACTGATTTTGA | 2822 | 2841 | sooossssssssssooss | 5-10-5 | 2387 |
| 664806 | 135859 | 135876 | TCCCATCACTGATTTTGA | 2822 | 2839 | sooossssssssooss | 5-7-6 | 2385 |
| 664538 | 135860 | 135877 | CTCCCATCACTGATTTTG | 2823 | 2840 | sooossssssssssooss | 5-8-5 | 2388 |
| 664754 | 135860 | 135878 | ACTCCCATCACTGATTTTG | 2823 | 2841 | sooossssssssssooss | 5-9-5 | 2389 |
| 664701 | 135860 | 135879 | TACTCCCATCACTGATTTTG | 2823 | 2842 | sooossssssssssooss | 5-10-5 | 2390 |
| 664807 | 135860 | 135877 | CTCCCATCACTGATTTTG | 2823 | 2840 | sooossssssssooss | 5-7-6 | 2388 |
| 622122 | 135861 | 135878 | ACTCCCATCACTGATTTT | 2824 | 2841 | sooossssssssssooss | 5-8-5 | 1670 |
| 664755 | 135861 | 135879 | TACTCCCATCACTGATTTT | 2824 | 2842 | sooossssssssssooss | 5-9-5 | 2391 |
| 664702 | 135861 | 135880 | TTACTCCCATCACTGATTTT | 2824 | 2843 | sooossssssssssooss | 5-10-5 | 2392 |
| 664808 | 135861 | 135878 | ACTCCCATCACTGATTTT | 2824 | 2841 | sooossssssssooss | 5-7-6 | 1670 |
| 664539 | 135862 | 135879 | TACTCCCATCACTGATTT | 2825 | 2842 | sooossssssssssooss | 5-8-5 | 2393 |
| 664756 | 135862 | 135880 | TTACTCCCATCACTGATTT | 2825 | 2843 | sooossssssssssooss | 5-9-5 | 2394 |
| 664703 | 135862 | 135881 | CTTACTCCCATCACTGATTT | 2825 | 2844 | sooossssssssssooss | 5-10-5 | 2395 |
| 664809 | 135862 | 135879 | TACTCCCATCACTGATTT | 2825 | 2842 | sooossssssssooss | 5-7-6 | 2393 |
| 664540 | 135863 | 135880 | TTACTCCCATCACTGATT | 2826 | 2843 | sooossssssssssooss | 5-8-5 | 2396 |
| 664757 | 135863 | 135881 | CTTACTCCCATCACTGATT | 2826 | 2844 | sooossssssssssooss | 5-9-5 | 2397 |
| 664704 | 135863 | 135882 | TCTTACTCCCATCACTGATT | 2826 | 2845 | sooossssssssssooss | 5-10-5 | 2398 |
| 664810 | 135863 | 135880 | TTACTCCCATCACTGATT | 2826 | 2843 | sooossssssssooss | 5-7-6 | 2396 |
| 622123 | 135864 | 135881 | CTTACTCCCATCACTGAT | 2827 | 2844 | sooossssssssssooss | 5-8-5 | 1671 |
| 664758 | 135864 | 135882 | TCTTACTCCCATCACTGAT | 2827 | 2845 | sooossssssssssooss | 5-9-5 | 2399 |
| 664705 | 135864 | 135883 | CTCTTACTCCCATCACTGAT | 2827 | 2846 | sooossssssssssooss | 5-10-5 | 2400 |
| 664811 | 135864 | 135881 | CTTACTCCCATCACTGAT | 2827 | 2844 | sooossssssssooss | 5-7-6 | 1671 |
| 664541 | 135865 | 135882 | TCTTACTCCCATCACTGA | 2828 | 2845 | sooossssssssssooss | 5-8-5 | 2401 |
| 664759 | 135865 | 135883 | CTCTTACTCCCATCACTGA | 2828 | 2846 | sooossssssssssooss | 5-9-5 | 2402 |
| 664706 | 135865 | 135884 | GCTCTTACTCCCATCACTGA | 2828 | 2847 | sooossssssssssooss | 5-10-5 | 2403 |
| 664812 | 135865 | 135882 | TCTTACTCCCATCACTGA | 2828 | 2845 | sooossssssssooss | 5-7-6 | 2401 |
| 664542 | 135866 | 135883 | CTCTTACTCCCATCACTG | 2829 | 2846 | sooossssssssssooss | 5-8-5 | 2404 |
| 664760 | 135866 | 135884 | GCTCTTACTCCCATCACTG | 2829 | 2847 | sooossssssssssooss | 5-9-5 | 2405 |

TABLE 56-continued

MOE gapmers targeting SEQ ID NOs: 1 and 2

| ISIS NO | SEQ ID NO: 1 Start Site | SEQ ID NO: 1 Stop Site | Sequence | SEQ ID NO: 2 Start Site | SEQ ID NO: 2 Stop Site | Linkage chemistry | Motif | SEQ ID NO |
|---|---|---|---|---|---|---|---|---|
| 664707 | 135866 | 135885 | TGCTCTTACTCCCATCACTG | 2829 | 2848 | sooosssssssssssooss | 5-10-5 | 2406 |
| 664813 | 135866 | 135883 | CTCTTACTCCCATCACTG | 2829 | 2846 | sooossssssssoooss | 5-7-6 | 2404 |
| 622124 | 135867 | 135884 | GCTCTTACTCCCATCACT | 2830 | 2847 | sooossssssssssooss | 5-8-5 | 1672 |
| 664761 | 135867 | 135885 | TGCTCTTACTCCCATCACT | 2830 | 2848 | sooosssssssssssooss | 5-9-5 | 2407 |
| 664708 | 135867 | 135886 | TTGCTCTTACTCCCATCACT | 2830 | 2849 | sooossssssssssssooss | 5-10-5 | 2408 |
| 664814 | 135867 | 135884 | GCTCTTACTCCCATCACT | 2830 | 2847 | sooossssssssoooss | 5-7-6 | 1672 |
| 623993 | 135868 | 135885 | TGCTCTTACTCCCATCAC | 2831 | 2848 | sooossssssssssooss | 5-8-5 | 2306 |
| 664762 | 135868 | 135886 | TTGCTCTTACTCCCATCAC | 2831 | 2849 | sooosssssssssssooss | 5-9-5 | 2409 |
| 664709 | 135868 | 135887 | TTTGCTCTTACTCCCATCAC | 2831 | 2850 | sooossssssssssssooss | 5-10-5 | 2410 |
| 664815 | 135868 | 135885 | TGCTCTTACTCCCATCAC | 2831 | 2848 | sooossssssssoooss | 5-7-6 | 2306 |
| 623994 | 135869 | 135886 | TTGCTCTTACTCCCATCA | 2832 | 2849 | sooossssssssssooss | 5-8-5 | 2307 |
| 664763 | 135869 | 135887 | TTTGCTCTTACTCCCATCA | 2832 | 2850 | sooosssssssssssooss | 5-9-5 | 2411 |
| 664710 | 135869 | 135888 | ATTTGCTCTTACTCCCATCA | 2832 | 2851 | sooossssssssssssooss | 5-10-5 | 2412 |
| 664816 | 135869 | 135886 | TTGCTCTTACTCCCATCA | 2832 | 2849 | sooossssssssoooss | 5-7-6 | 2307 |
| 622125 | 135870 | 135887 | TTTGCTCTTACTCCCATC | 2833 | 2850 | sooossssssssssooss | 5-8-5 | 1673 |
| 664764 | 135870 | 135888 | ATTTGCTCTTACTCCCATC | 2833 | 2851 | sooosssssssssssooss | 5-9-5 | 2413 |
| 664711 | 135870 | 135889 | AATTTGCTCTTACTCCCATC | 2833 | 2852 | sooossssssssssssooss | 5-10-5 | 2414 |
| 664817 | 135870 | 135887 | TTTGCTCTTACTCCCATC | 2833 | 2850 | sooossssssssoooss | 5-7-6 | 1673 |
| 623995 | 135871 | 135888 | ATTTGCTCTTACTCCCAT | 2834 | 2851 | sooossssssssssooss | 5-8-5 | 2308 |
| 664765 | 135871 | 135889 | AATTTGCTCTTACTCCCAT | 2834 | 2852 | sooosssssssssssooss | 5-9-5 | 2415 |
| 664712 | 135871 | 135890 | AAATTTGCTCTTACTCCCAT | 2834 | 2853 | sooossssssssssssooss | 5-10-5 | 2416 |
| 664818 | 135871 | 135888 | ATTTGCTCTTACTCCCAT | 2834 | 2851 | sooossssssssoooss | 5-7-6 | 2308 |
| 623996 | 135872 | 135889 | AATTTGCTCTTACTCCCA | 2835 | 2852 | sooossssssssssooss | 5-8-5 | 2309 |
| 664766 | 135872 | 135890 | AAATTTGCTCTTACTCCCA | 2835 | 2853 | sooosssssssssssooss | 5-9-5 | 2417 |
| 664713 | 135872 | 135891 | GAAATTTGCTCTTACTCCCA | 2835 | 2854 | sooossssssssssssooss | 5-10-5 | 2418 |
| 664819 | 135872 | 135889 | AATTTGCTCTTACTCCCA | 2835 | 2852 | sooossssssssoooss | 5-7-6 | 2309 |

Example 15

Intracerebroventricular Administration of Antisense Oligonucleotides Against Human Tau mRNA in Htau Mice Selected compounds were tested for efficacy by ICV administration in human tau transgenic mice (Duff et al., *Neurobiology of Disease* 7:87-98, 2000).
Treatment and Surgery Groups of 4 mice each were administered ISIS 613255, ISIS 613329, ISIS 613344, ISIS 613361, ISIS 613369, ISIS 613370, ISIS 613397, ISIS 613045, ISIS 613099, ISIS 613118, ISIS 613136 with a 200 µg dose delivered by ICV bolus injection. A control group of 2 mice was similarly treated with ISIS 424880 and a control group of 4 mice was similarly treated with PBS. All procedures were performed under isoflourane anesthesia and in accordance with IACUC regulations. For mouse ICV bolus injections, the antisense oligonucleotide was injected into the right lateral ventricle of human tau transgenic mice. Ten microliters of solution containing 300 µg of oligonucleotide in PBS was injected over approximately 10 seconds. Tissue was collected 14 days after oligonucleotide administration.
RNA Analysis On day 14 after the oligonucleotide administration, RNA was extracted from the hippocampus, spinal cord and cortex for real-time PCR analysis of tau mRNA levels. Human tau mRNA levels were measured using the human primer probe set RTS3104. Results were calculated as percent inhibition of human tau mRNA expression compared to the control. All the antisense oligonucleotides effect significant inhibition of human tau mRNA levels.

TABLE 57

Percent reduction of human tau mRNA levels in hTau mice

| ISIS No | Cortex | Hippocampus | Spinal Cord |
|---|---|---|---|
| 613255 | 30 | 46 | 36 |
| 613329 | 20 | 69 | 67 |
| 613344 | 41 | 42 | 34 |
| 613361 | 69 | 57 | 72 |
| 613369 | 17 | 48 | 46 |
| 613370 | 42 | 61 | 63 |
| 613397 | 33 | 41 | 57 |
| 613045 | 12 | 38 | 47 |
| 613099 | 42 | 55 | 54 |
| 613118 | 64 | 73 | 58 |
| 613136 | 26 | 39 | 27 |
| 424880 | 50 | 53 | 55 |

Example 16

Antisense Inhibition of Human Tau in SH-SY5Y Cells 5-7-6 MOE, 5-8-5 MOE, 5-9-5 MOE, and 5-10-5 MOE Gapmers The antisense oligonucleotides described in the Examples above, as well as newly designed antisense oligonucleotides targeting a human tau nucleic acid, were tested in a series of experiments that had similar culture conditions. The results for each experiment are presented in separate tables shown below.

Cultured SH-SY5Y cells were transfected using electroporation with 8,000 nM antisense oligonucleotide. After a treatment period of approximately 24 hours, RNA was isolated from the cells and tau mRNA levels were measured by quantitative real-time PCR. Human primer probe set RTS3104 was used to measure mRNA levels. Tau mRNA levels were adjusted according to total RNA content, as measured by RIBOGREEN®. Results are presented as percent inhibition of tau, relative to untreated control cells.

The newly designed chimeric antisense oligonucleotides in the Tables below were designed as 5-7-6 MOE, 5-8-5 MOE, 5-9-5 MOE, or 5-10-5 MOE gapmers. The 5-7-6 MOE gapmers are 18 nucleosides in length, wherein the central gap segment comprises of seven 2'-deoxynucleosides and is flanked by wing segments on the 5' direction and the 3' direction comprising five and six nucleosides respectively. The 5-8-5 MOE gapmers are 18 nucleosides in length, wherein the central gap segment comprises of eight 2'-deoxynucleosides and is flanked by wing segments on the 5' direction and the 3' direction comprising five nucleosides each. The 5-9-5 MOE gapmers are 19 nucleosides in length, wherein the central gap segment comprises of nine 2'-deoxynucleosides and is flanked by wing segments on the 5' direction and the 3' direction comprising five nucleosides each. The 5-10-5 MOE gapmers are 20 nucleosides in length, wherein the central gap segment comprises of ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are either phosphorothioate linkages or phosphodiester linkages. The 'Linkage Chemistry' column describes the internucleoside linkages of each oligonucleotide. 's' indicates phosphorothioate linkage and 'o' indicates phosphodiester linkage. All cytosine residues throughout each gapmer are 5-methylcytosines.

"Start site" indicates the 5'-most nucleoside to which the gapmer is targeted in the human gene sequence. "Stop site" indicates the 3'-most nucleoside to which the gapmer is targeted in the human gene sequence. Each gapmer listed in the Table below is targeted to either the human tau genomic sequence, designated herein as SEQ ID NO: 1 (GENBANK Accession No. NT_010783.15 truncated from nucleotides 9240000 to 9381000) or to the human tau mRNA sequence, designated herein as SEQ ID NO: 2 (GENBANK Accession No. NM_001123066.3). 'n/a' indicates that the antisense oligonucleotide does not target that particular gene sequence with 100% complementarity.

TABLE 58

| ISIS NO | SEQ ID NO: 1 start site | SEQ ID NO: 1 stop site | Sequence | SEQ ID NO: 2 start site | SEQ ID NO: 2 stop site | Linkage Chemistry | Motif | % inhibition | SEQ ID NO |
|---|---|---|---|---|---|---|---|---|---|
| 623965 | 73880 | 73897 | TGATCTTCCATCACTTCG | n/a | n/a | sooossssssssooss | 5-8-5 | 52 | 2278 |
| 620887 | 98891 98928 | 98908 98945 | GTTTTCAAACACACCTTC | n/a | n/a | sooossssssssooss | 5-8-5 | 91 | 665 |
| 664511 | 135820 | 135837 | GACAAAAGCAGGTTAAGT | 2783 | 2800 | sooossssssssooss | 5-8-5 | 65 | 2331 |
| 664767 | 135820 | 135837 | GACAAAAGCAGGTTAAGT | 2783 | 2800 | sooossssssssooss | 5-7-6 | 21 | 2331 |
| 664512 | 135821 | 135838 | TGACAAAAGCAGGTTAAG | 2784 | 2801 | sooossssssssooss | 5-8-5 | 60 | 2334 |
| 664768 | 135821 | 135838 | TGACAAAAGCAGGTTAAG | 2784 | 2801 | sooossssssssooss | 5-7-6 | 30 | 2334 |
| 622109 | 135822 | 135839 | GTGACAAAAGCAGGTTAA | 2785 | 2802 | sooossssssssooss | 5-8-5 | 72 | 2038 |
| 664769 | 135822 | 135839 | GTGACAAAAGCAGGTTAA | 2785 | 2802 | sooossssssssooss | 5-7-6 | 49 | 2038 |
| 664513 | 135823 | 135840 | AGTGACAAAAGCAGGTTA | 2786 | 2803 | sooossssssssooss | 5-8-5 | 56 | 2339 |
| 664770 | 135823 | 135840 | AGTGACAAAAGCAGGTTA | 2786 | 2803 | sooossssssssooss | 5-7-6 | 45 | 2339 |

TABLE 58-continued

| ISIS NO | SEQ ID NO: 1 start site | SEQ ID NO: 1 stop site | Sequence | SEQ ID NO: 2 start site | SEQ ID NO: 2 stop site | Linkage Chemistry | Motif | % inhibition | SEQ ID NO |
|---|---|---|---|---|---|---|---|---|---|
| 664514 | 135824 | 135841 | GAGTGACAAAAGCAGGTT | 2787 | 2804 | sooossssssssssooss | 5-8-5 | 84 | 2342 |
| 664771 | 135824 | 135841 | GAGTGACAAAAGCAGGTT | 2787 | 2804 | sooosssssssssooss | 5-7-6 | 63 | 2342 |
| 622110 | 135825 | 135842 | CGAGTGACAAAAGCAGGT | 2788 | 2805 | sooossssssssssooss | 5-8-5 | 77 | 2039 |
| 664772 | 135825 | 135842 | CGAGTGACAAAAGCAGGT | 2788 | 2805 | sooosssssssssooss | 5-7-6 | 37 | 2039 |
| 664515 | 135826 | 135843 | CCGAGTGACAAAAGCAGG | 2789 | 2806 | sooossssssssssooss | 5-8-5 | 70 | 2347 |
| 664773 | 135826 | 135843 | CCGAGTGACAAAAGCAGG | 2789 | 2806 | sooosssssssssooss | 5-7-6 | 62 | 2347 |
| 664516 | 135827 | 135844 | GCCGAGTGACAAAAGCAG | 2790 | 2807 | sooossssssssssooss | 5-8-5 | 79 | 2350 |
| 664774 | 135827 | 135844 | GCCGAGTGACAAAAGCAG | 2790 | 2807 | sooosssssssssooss | 5-7-6 | 70 | 2350 |
| 622111 | 135828 | 135845 | AGCCGAGTGACAAAAGCA | 2791 | 2808 | sooossssssssssooss | 5-8-5 | 75 | 2040 |
| 664775 | 135828 | 135845 | AGCCGAGTGACAAAAGCA | 2791 | 2808 | sooosssssssssooss | 5-7-6 | 78 | 2040 |
| 664517 | 135829 | 135846 | AAGCCGAGTGACAAAAGC | 2792 | 2809 | sooossssssssssooss | 5-8-5 | 67 | 2355 |
| 664776 | 135829 | 135846 | AAGCCGAGTGACAAAAGC | 2792 | 2809 | sooosssssssssooss | 5-7-6 | 50 | 2355 |
| 664518 | 135830 | 135847 | AAAGCCGAGTGACAAAAG | 2793 | 2810 | sooossssssssssooss | 5-8-5 | 47 | 2358 |
| 664777 | 135830 | 135847 | AAAGCCGAGTGACAAAAG | 2793 | 2810 | sooosssssssssooss | 5-7-6 | 42 | 2358 |
| 622112 | 135831 | 135848 | CAAAGCCGAGTGACAAAA | 2794 | 2811 | sooossssssssssooss | 5-8-5 | 46 | 2041 |
| 664778 | 135831 | 135848 | CAAAGCCGAGTGACAAAA | 2794 | 2811 | sooosssssssssooss | 5-7-6 | 34 | 2041 |
| 664519 | 135832 | 135849 | CCAAAGCCGAGTGACAAA | 2795 | 2812 | sooossssssssssooss | 5-8-5 | 57 | 2363 |
| 664779 | 135832 | 135849 | CCAAAGCCGAGTGACAAA | 2795 | 2812 | sooosssssssssooss | 5-7-6 | 34 | 2363 |
| 664520 | 135833 | 135850 | GCCAAAGCCGAGTGACAA | 2796 | 2813 | sooossssssssssooss | 5-8-5 | 63 | 2366 |
| 664780 | 135833 | 135850 | GCCAAAGCCGAGTGACAA | 2796 | 2813 | sooosssssssssooss | 5-7-6 | 66 | 2366 |
| 622113 | 135834 | 135851 | AGCCAAAGCCGAGTGACA | 2797 | 2814 | sooossssssssssooss | 5-8-5 | 70 | 2042 |
| 664781 | 135834 | 135851 | AGCCAAAGCCGAGTGACA | 2797 | 2814 | sooosssssssssooss | 5-7-6 | 74 | 2042 |
| 664521 | 135835 | 135852 | GAGCCAAAGCCGAGTGAC | 2798 | 2815 | sooossssssssssooss | 5-8-5 | 71 | 2420 |
| 664782 | 135835 | 135852 | GAGCCAAAGCCGAGTGAC | 2798 | 2815 | sooosssssssssooss | 5-7-6 | 31 | 2420 |
| 664522 | 135836 | 135853 | CGAGCCAAAGCCGAGTGA | 2799 | 2816 | sooossssssssssooss | 5-8-5 | 50 | 2423 |
| 664783 | 135836 | 135853 | CGAGCCAAAGCCGAGTGA | 2799 | 2816 | sooosssssssssooss | 5-7-6 | 30 | 2423 |
| 622114 | 135837 | 135854 | CCGAGCCAAAGCCGAGTG | 2800 | 2817 | sooossssssssssooss | 5-8-5 | 72 | 2043 |
| 664784 | 135837 | 135854 | CCGAGCCAAAGCCGAGTG | 2800 | 2817 | sooosssssssssooss | 5-7-6 | 76 | 2043 |
| 664523 | 135838 | 135855 | CCCGAGCCAAAGCCGAGT | 2801 | 2818 | sooossssssssssooss | 5-8-5 | 70 | 2428 |
| 664785 | 135838 | 135855 | CCCGAGCCAAAGCCGAGT | 2801 | 2818 | sooosssssssssooss | 5-7-6 | 56 | 2428 |
| 664524 | 135839 | 135856 | TCCCGAGCCAAAGCCGAG | 2802 | 2819 | sooossssssssssooss | 5-8-5 | 55 | 2431 |
| 664786 | 135839 | 135856 | TCCCGAGCCAAAGCCGAG | 2802 | 2819 | sooosssssssssooss | 5-7-6 | 36 | 2431 |
| 622115 | 135840 | 135857 | GTCCCGAGCCAAAGCCGA | 2803 | 2820 | sooossssssssssooss | 5-8-5 | 59 | 2044 |
| 664787 | 135840 | 135857 | GTCCCGAGCCAAAGCCGA | 2803 | 2820 | sooosssssssssooss | 5-7-6 | 54 | 2044 |
| 664525 | 135841 | 135858 | AGTCCCGAGCCAAAGCCG | 2804 | 2821 | sooossssssssssooss | 5-8-5 | 74 | 2436 |
| 664788 | 135841 | 135858 | AGTCCCGAGCCAAAGCCG | 2804 | 2821 | sooosssssssssooss | 5-7-6 | 77 | 2436 |
| 664789 | 135842 | 135859 | AAGTCCCGAGCCAAAGCC | 2805 | 2822 | sooosssssssssooss | 5-7-6 | 42 | 2439 |

TABLE 58-continued

| ISIS NO | SEQ ID NO: 1 start site | SEQ ID NO: 1 stop site | Sequence | SEQ ID NO: 2 start site | SEQ ID NO: 2 stop site | Linkage Chemistry | Motif | % inhibition | SEQ ID NO |
|---|---|---|---|---|---|---|---|---|---|
| 664790 | 135843 | 135860 | GAAGTCCCGAGCCAAAGC | 2806 | 2823 | sooosssssssssooss | 5-7-6 | 38 | 2045 |
| 664791 | 135844 | 135861 | TGAAGTCCCGAGCCAAAG | 2807 | 2824 | sooosssssssssooss | 5-7-6 | 44 | 2478 |
| 664792 | 135845 | 135862 | TTGAAGTCCCGAGCCAAA | 2808 | 2825 | sooosssssssssooss | 5-7-6 | 44 | 2479 |
| 664793 | 135846 | 135863 | TTTGAAGTCCCGAGCCAA | 2809 | 2826 | sooosssssssssooss | 5-7-6 | 29 | 2046 |
| 664794 | 135847 | 135864 | TTTTGAAGTCCCGAGCCA | 2810 | 2827 | sooosssssssssooss | 5-7-6 | 32 | 2480 |
| 664795 | 135848 | 135865 | ATTTTGAAGTCCCGAGCC | 2811 | 2828 | sooosssssssssooss | 5-7-6 | 15 | 2481 |
| 664796 | 135849 | 135866 | GATTTTGAAGTCCCGAGC | 2812 | 2829 | sooosssssssssooss | 5-7-6 | 76 | 2047 |
| 664797 | 135850 | 135867 | TGATTTTGAAGTCCCGAG | 2813 | 2830 | sooosssssssssooss | 5-7-6 | 70 | 2482 |
| 664798 | 135851 | 135868 | CTGATTTTGAAGTCCCGA | 2814 | 2831 | sooosssssssssooss | 5-7-6 | 75 | 2483 |
| 664799 | 135852 | 135869 | ACTGATTTTGAAGTCCCG | 2815 | 2832 | sooosssssssssooss | 5-7-6 | 79 | 2048 |
| 664800 | 135853 | 135870 | CACTGATTTTGAAGTCCC | 2816 | 2833 | sooosssssssssooss | 5-7-6 | 82 | 2370 |
| 664534 | 135854 | 135871 | TCACTGATTTTGAAGTCC | 2817 | 2834 | sooosssssssssooss | 5-8-5 | 78 | 2372 |
| 664801 | 135854 | 135871 | TCACTGATTTTGAAGTCC | 2817 | 2834 | sooosssssssssooss | 5-7-6 | 29 | 2372 |
| 664802 | 135855 | 135872 | ATCACTGATTTTGAAGTC | 2818 | 2835 | sooosssssssssooss | 5-7-6 | 52 | 1668 |
| 664803 | 135856 | 135873 | CATCACTGATTTTGAAGT | 2819 | 2836 | sooosssssssssooss | 5-7-6 | 55 | 2377 |
| 664804 | 135857 | 135874 | CCATCACTGATTTTGAAG | 2820 | 2837 | sooosssssssssooss | 5-7-6 | 38 | 2380 |
| 664805 | 135858 | 135875 | CCCATCACTGATTTTGAA | 2821 | 2838 | sooosssssssssooss | 5-7-6 | 62 | 1669 |
| 664806 | 135859 | 135876 | TCCCATCACTGATTTTGA | 2822 | 2839 | sooosssssssssooss | 5-7-6 | 72 | 2385 |
| 664807 | 135860 | 135877 | CTCCCATCACTGATTTTG | 2823 | 2840 | sooosssssssssooss | 5-7-6 | 55 | 2388 |
| 664808 | 135861 | 135878 | ACTCCCATCACTGATTTT | 2824 | 2841 | sooosssssssssooss | 5-7-6 | 38 | 1670 |
| 664809 | 135862 | 135879 | TACTCCCATCACTGATTT | 2825 | 2842 | sooosssssssssooss | 5-7-6 | 54 | 2393 |
| 664810 | 135863 | 135880 | TTACTCCCATCACTGATT | 2826 | 2843 | sooosssssssssooss | 5-7-6 | 39 | 2396 |
| 664811 | 135864 | 135881 | CTTACTCCCATCACTGAT | 2827 | 2844 | sooosssssssssooss | 5-7-6 | 39 | 1671 |
| 664812 | 135865 | 135882 | TCTTACTCCCATCACTGA | 2828 | 2845 | sooosssssssssooss | 5-7-6 | 45 | 2401 |
| 664813 | 135866 | 135883 | CTCTTACTCCCATCACTG | 2829 | 2846 | sooosssssssssooss | 5-7-6 | 61 | 2404 |
| 664814 | 135867 | 135884 | GCTCTTACTCCCATCACT | 2830 | 2847 | sooosssssssssooss | 5-7-6 | 14 | 1672 |
| 664815 | 135868 | 135885 | TGCTCTTACTCCCATCAC | 2831 | 2848 | sooosssssssssooss | 5-7-6 | 70 | 2306 |
| 664816 | 135869 | 135886 | TTGCTCTTACTCCCATCA | 2832 | 2849 | sooosssssssssooss | 5-7-6 | 72 | 2307 |
| 664817 | 135870 | 135887 | TTTGCTCTTACTCCCATC | 2833 | 2850 | sooosssssssssooss | 5-7-6 | 62 | 1673 |
| 664818 | 135871 | 135888 | ATTTGCTCTTACTCCCAT | 2834 | 2851 | sooosssssssssooss | 5-7-6 | 69 | 2308 |
| 664819 | 135872 | 135889 | AATTTGCTCTTACTCCCA | 2835 | 2852 | sooosssssssssooss | 5-7-6 | 67 | 2309 |

TABLE 59

| ISIS NO | SEQ ID NO: 1 start site | SEQ ID NO: 1 stop site | Sequence | SEQ ID NO: 2 start site | SEQ ID NO: 2 stop site | Linkage Chemistry | Motif | % inhibition | SEQ ID NO |
|---|---|---|---|---|---|---|---|---|---|
| 665045 | 21592 | 21609 | ACATCCAAATAACAATAT | n/a | n/a | sooossssssssssooss | 5-8-5 | 1 | 2444 |
| 665046 | 21617 | 21634 | TCCTGTCTCAAACACCTA | n/a | n/a | sooossssssssssooss | 5-8-5 | 44 | 2445 |
| 665047 | 30083 | 30100 | AGCTTATCACAGTAGGTG | n/a | n/a | sooossssssssssooss | 5-8-5 | 94 | 2446 |
| 665048 | 30108 | 30125 | CCTTTGCTTCACACACCA | n/a | n/a | sooossssssssssooss | 5-8-5 | 67 | 2447 |
| 621013 | 30133 | 30150 | AGCTCACTACAGCAGGCA | n/a | n/a | sooossssssssssooss | 5-8-5 | 90 | 868 |
| 665049 | 30158 | 30175 | TGGTTCTACAACCTGCCC | n/a | n/a | sooossssssssssooss | 5-8-5 | 57 | 2448 |
| 665050 | 30183 | 30200 | CCTTTGTAACCTTGGAAC | n/a | n/a | sooossssssssssooss | 5-8-5 | 25 | 2449 |
| 665051 | 33838 | 33855 | AGTTAAAAGATGGCAACC | n/a | n/a | sooossssssssssooss | 5-8-5 | 32 | 2450 |
| 665052 | 33863 | 33880 | CTGGGCATTTTGATAAAA | n/a | n/a | sooossssssssssooss | 5-8-5 | 28 | 2451 |
| 621031 | 33888 | 33905 | GGTATAATTTGTTTGGAC | n/a | n/a | sooossssssssssooss | 5-8-5 | 85 | 886 |
| 665053 | 33913 | 33930 | AGTGCCAGACATTTTCAA | n/a | n/a | sooossssssssssooss | 5-8-5 | 20 | 2452 |
| 665054 | 33938 | 33955 | CTGGCACAACAGGCATTG | n/a | n/a | sooossssssssssooss | 5-8-5 | 25 | 2453 |
| 621041 | 35721 | 35738 | TTGCCATCTTGGACAGGG | n/a | n/a | sooossssssssssooss | 5-8-5 | 70 | 896 |
| 665055 | 35746 | 35763 | GTGGTACAGAGGCTGTGT | n/a | n/a | sooossssssssssooss | 5-8-5 | 47 | 2454 |
| 665056 | 35771 | 35788 | TTGCAGATTCTGAATACC | n/a | n/a | sooossssssssssooss | 5-8-5 | 78 | 2455 |
| 665057 | 64499 | 64516 | TATGATTCCCAGGAGTCT | n/a | n/a | sooossssssssssooss | 5-8-5 | 0 | 2456 |
| 621181 | 64543 | 64560 | GTAGGTGTCATCATCATC | n/a | n/a | sooossssssssssooss | 5-8-5 | 77 | 1113 |
| 665058 | 64568 | 64585 | GTGACCCTTCAGGGCAAT | n/a | n/a | sooossssssssssooss | 5-8-5 | 35 | 2457 |
| 665059 | 64593 | 64610 | ATGCAGGTGCCTTGCAGG | n/a | n/a | sooossssssssssooss | 5-8-5 | 36 | 2458 |
| 623965 | 73880 | 73897 | TGATCTTCCATCACTTCG | n/a | n/a | sooossssssssssooss | 5-8-5 | 48 | 2278 |
| 665060 | 77364 | 77381 | CCTGCTGCCAACAGTAGA | n/a | n/a | sooossssssssssooss | 5-8-5 | 51 | 2459 |
| 665061 | 77389 | 77406 | CCCTCACGGGCTGTTGTG | n/a | n/a | sooossssssssssooss | 5-8-5 | 20 | 2460 |
| 621236 | 77414 | 77431 | TCATCTGTGAAGCGGACG | 73377 | 73394 | sooossssssssssooss | 5-8-5 | 79 | 706 |
| 665062 | 77439 | 77456 | ACGGTCTGAGCATGAGGC | n/a | n/a | sooossssssssssooss | 5-8-5 | 77 | 2461 |
| 665063 | 77464 | 77481 | AGCCATGGACCTGCTCTG | n/a | n/a | sooossssssssssooss | 5-8-5 | 48 | 2462 |
| 665064 | 77731 | 77748 | GACAGTATACCCCACATC | n/a | n/a | sooossssssssssooss | 5-8-5 | 48 | 2463 |
| 621238 | 77781 | 77798 | GTTATTTTGGAACAGTTT | 73744 | 73761 | sooossssssssssooss | 5-8-5 | 89 | 708 |
| 665065 | 78142 | 78159 | AAGAGTGGTAAAACCTAC | n/a | n/a | sooossssssssssooss | 5-8-5 | 51 | 2464 |
| 665066 | 80259 | 80276 | GCTCACCAGCAGGAACTT | n/a | n/a | sooossssssssssooss | 5-8-5 | 56 | 2465 |
| 665067 | 80284 | 80301 | AAGGGCCCAGTGTAGCAC | n/a | n/a | sooossssssssssooss | 5-8-5 | 66 | 2466 |
| 621251 | 80309 | 80326 | AGTCATTATCATGTCACC | 76272 | 76289 | sooossssssssssooss | 5-8-5 | 73 | 721 |
| 665068 | 80334 | 80351 | CCAATAAGTGGCAGTGAT | n/a | n/a | sooossssssssssooss | 5-8-5 | 49 | 2467 |
| 665069 | 80359 | 80376 | ACCATGCCTGGCAGATGA | n/a | n/a | sooossssssssssooss | 5-8-5 | 66 | 2468 |
| 665070 | 80799 | 80816 | CTTAGTCATCTTCCCTCA | n/a | n/a | sooossssssssssooss | 5-8-5 | 64 | 2469 |
| 665071 | 80824 | 80841 | ATTTCTGAATTCTTTGCC | n/a | n/a | sooossssssssssooss | 5-8-5 | 69 | 2470 |
| 621254 | 80849 | 80866 | GGTAACATGTAAAGCTTC | 76812 | 76829 | sooossssssssssooss | 5-8-5 | 76 | 724 |
| 665072 | 82508 | 82525 | CTTACACTCTGGAAGGTT | n/a | n/a | sooossssssssssooss | 5-8-5 | 74 | 2471 |
| 665073 | 82533 | 82550 | TATCCAGGGCTGAGCAGG | n/a | n/a | sooossssssssssooss | 5-8-5 | 38 | 2472 |

TABLE 59-continued

| ISIS NO | SEQ ID NO: 1 start site | SEQ ID NO: 1 stop site | Sequence | SEQ ID NO: 2 start site | SEQ ID NO: 2 stop site | Linkage Chemistry | Motif | % inhibition | SEQ ID NO |
|---|---|---|---|---|---|---|---|---|---|
| 621263 | 82558 | 82575 | ATGGGCTTATCAATGCAT | 78521 | 78538 | sooossssssssooss | 5-8-5 | 80 | 733 |
| 665074 | 82583 | 82600 | GGAGTCAATCTGCCCTGG | n/a | n/a | sooossssssssooss | 5-8-5 | 54 | 2473 |
| 665075 | 82608 | 82625 | CTTCCCTGTGGCACTTTG | n/a | n/a | sooossssssssooss | 5-8-5 | 29 | 2474 |
| 665076 | 89600 | 89617 | ATGCCTCACTCAACAAGG | n/a | n/a | sooossssssssooss | 5-8-5 | 26 | 2475 |
| 665077 | 89625 | 89642 | CTCCACTTTGGGACCAGG | n/a | n/a | sooossssssssooss | 5-8-5 | 87 | 2476 |
| 621302 | 89650 | 89667 | GCTATGACCTAGTAGGAA | n/a | n/a | sooossssssssooss | 5-8-5 | 68 | 772 |
| 665078 | 89675 | 89692 | GGCACAGCACCCACATGC | n/a | n/a | sooossssssssooss | 5-8-5 | 66 | 2477 |
| 665079 | 89700 | 89717 | GGTGATAAAAGTTCACTA | n/a | n/a | sooossssssssooss | 5-8-5 | 63 | 2531 |
| 620887 | 98891 98928 | 98908 98945 | GTTTTCAAACACACCTTC | n/a | n/a | sooossssssssooss | 5-8-5 | 91 | 665 |
| 664526 | 135842 | 135859 | AAGTCCCGAGCCAAAGCC | 2805 | 2822 | sooossssssssooss | 5-8-5 | 55 | 2439 |
| 622116 | 135843 | 135860 | GAAGTCCCGAGCCAAAGC | 2806 | 2823 | sooossssssssooss | 5-8-5 | 63 | 2045 |
| 664527 | 135844 | 135861 | TGAAGTCCCGAGCCAAAG | 2807 | 2824 | sooossssssssooss | 5-8-5 | 40 | 2478 |
| 664528 | 135845 | 135862 | TTGAAGTCCCGAGCCAAA | 2808 | 2825 | sooossssssssooss | 5-8-5 | 61 | 2479 |
| 622117 | 135846 | 135863 | TTTGAAGTCCCGAGCCAA | 2809 | 2826 | sooossssssssooss | 5-8-5 | 55 | 2046 |
| 664529 | 135847 | 135864 | TTTTGAAGTCCCGAGCCA | 2810 | 2827 | sooossssssssooss | 5-8-5 | 25 | 2480 |
| 664530 | 135848 | 135865 | ATTTTGAAGTCCCGAGCC | 2811 | 2828 | sooossssssssooss | 5-8-5 | 38 | 2481 |
| 622118 | 135849 | 135866 | GATTTTGAAGTCCCGAGC | 2812 | 2829 | sooossssssssooss | 5-8-5 | 63 | 2047 |
| 664531 | 135850 | 135867 | TGATTTTGAAGTCCCGAG | 2813 | 2830 | sooossssssssooss | 5-8-5 | 66 | 2482 |
| 664532 | 135851 | 135868 | CTGATTTTGAAGTCCCGA | 2814 | 2831 | sooossssssssooss | 5-8-5 | 73 | 2483 |
| 622119 | 135852 | 135869 | ACTGATTTTGAAGTCCCG | 2815 | 2832 | sooossssssssooss | 5-8-5 | 66 | 2048 |
| 664533 | 135853 | 135870 | CACTGATTTTGAAGTCCC | 2816 | 2833 | sooossssssssooss | 5-8-5 | 72 | 2370 |
| 664534 | 135854 | 135871 | TCACTGATTTTGAAGTCC | 2817 | 2834 | sooossssssssooss | 5-8-5 | 61 | 2372 |
| 622120 | 135855 | 135872 | ATCACTGATTTTGAAGTC | 2818 | 2835 | sooossssssssooss | 5-8-5 | 47 | 1668 |
| 664535 | 135856 | 135873 | CATCACTGATTTTGAAGT | 2819 | 2836 | sooossssssssooss | 5-8-5 | 59 | 2377 |
| 664536 | 135857 | 135874 | CCATCACTGATTTTGAAG | 2820 | 2837 | sooossssssssooss | 5-8-5 | 34 | 2380 |
| 622121 | 135858 | 135875 | CCCATCACTGATTTTGAA | 2821 | 2838 | sooossssssssooss | 5-8-5 | 49 | 1669 |
| 664537 | 135859 | 135876 | TCCCATCACTGATTTTGA | 2822 | 2839 | sooossssssssooss | 5-8-5 | 61 | 2385 |
| 664538 | 135860 | 135877 | CTCCCATCACTGATTTTG | 2823 | 2840 | sooossssssssooss | 5-8-5 | 76 | 2388 |
| 622122 | 135861 | 135878 | ACTCCCATCACTGATTTT | 2824 | 2841 | sooossssssssooss | 5-8-5 | 38 | 1670 |
| 664539 | 135862 | 135879 | TACTCCCATCACTGATTT | 2825 | 2842 | sooossssssssooss | 5-8-5 | 57 | 2393 |
| 664540 | 135863 | 135880 | TTACTCCCATCACTGATT | 2826 | 2843 | sooossssssssooss | 5-8-5 | 32 | 2396 |
| 622123 | 135864 | 135881 | CTTACTCCCATCACTGAT | 2827 | 2844 | sooossssssssooss | 5-8-5 | 33 | 1671 |
| 664541 | 135865 | 135882 | TCTTACTCCCATCACTGA | 2828 | 2845 | sooossssssssooss | 5-8-5 | 50 | 2401 |
| 664542 | 135866 | 135883 | CTCTTACTCCCATCACTG | 2829 | 2846 | sooossssssssooss | 5-8-5 | 58 | 2404 |
| 622124 | 135867 | 135884 | GCTCTTACTCCCATCACT | 2830 | 2847 | sooossssssssooss | 5-8-5 | 64 | 1672 |
| 623993 | 135868 | 135885 | TGCTCTTACTCCCATCAC | n/a | n/a | sooossssssssooss | 5-8-5 | 65 | 2306 |
| 623994 | 135869 | 135886 | TTGCTCTTACTCCCATCA | n/a | n/a | sooossssssssooss | 5-8-5 | 63 | 2307 |

TABLE 59-continued

| ISIS NO | SEQ ID NO: 1 start site | SEQ ID NO: 1 stop site | Sequence | SEQ ID NO: 2 start site | SEQ ID NO: 2 stop site | Linkage Chemistry | Motif | % inhibition | SEQ ID NO |
|---|---|---|---|---|---|---|---|---|---|
| 622125 | 135870 | 135887 | TTTGCTCTTACTCCCATC | 2833 | 2850 | sooosssssssssooss | 5-8-5 | 75 | 1673 |
| 623995 | 135871 | 135888 | ATTTGCTCTTACTCCCAT | n/a | n/a | sooosssssssssooss | 5-8-5 | 60 | 2308 |
| 623996 | 135872 | 135889 | AATTTGCTCTTACTCCCA | n/a | n/a | sooosssssssssooss | 5-8-5 | 72 | 2309 |

TABLE 60

| ISIS NO | SEQ ID NO: 1 start site | SEQ ID NO: 1 stop site | Sequence | SEQ ID NO: 2 start site | SEQ ID NO: 2 stop site | Linkage Chemistry | Motif | % inhibition | SEQ ID NO |
|---|---|---|---|---|---|---|---|---|---|
| 665043 | 73879 | 73897 | TGATCTTCCATCACTTCGA | 345 | 364 | sooosssssssssssooss | 5-9-5 | 67 | 2484 |
| 665044 | 98890 98927 | 98908 98945 | GTTTTCAAACACACCTTCA | n/a | n/a | sooosssssssssssooss | 5-9-5 | 90 | 2485 |
| 665081 | 120039 | 120057 | TTTTCTTACCACCCTAACA | n/a | n/a | sooosssssssssssooss | 5-9-5 | 28 | 2486 |
| 665082 | 120041 | 120059 | CGTTTTCTTACCACCCTAA | n/a | n/a | sooosssssssssssooss | 5-9-5 | 86 | 2487 |
| 665083 | 120045 | 120063 | AAACCGTTTTCTTACCACC | n/a | n/a | sooosssssssssssooss | 5-9-5 | 86 | 2488 |
| 665084 | 120047 | 120065 | AAAACCGTTTTCTTACCA | n/a | n/a | sooosssssssssssooss | 5-9-5 | 65 | 2489 |
| 665085 | 120060 | 120078 | AGCTCATCAAAGCAAAAC | n/a | n/a | sooosssssssssssooss | 5-9-5 | 65 | 2490 |
| 665086 | 120110 | 120128 | TCAAAAGACTATGTATTTT | n/a | n/a | sooosssssssssssooss | 5-9-5 | 54 | 2491 |
| 665087 | 120389 | 120407 | TGTAAATAATTGCCAAGTG | n/a | n/a | sooosssssssssssooss | 5-9-5 | 61 | 2492 |
| 665088 | 120439 | 120457 | TAAGCCACCATGCCTGTAA | n/a | n/a | sooosssssssssssooss | 5-9-5 | 61 | 2493 |
| 665089 | 121711 | 121729 | TGGACCCGCCTACTTGCTC | n/a | n/a | sooosssssssssssooss | 5-9-5 | 85 | 2494 |
| 665090 | 121736 | 121754 | TTTCGATGAGTGACATGCG | n/a | n/a | sooosssssssssssooss | 5-9-5 | 50 | 2495 |
| 665091 | 121761 | 121779 | TGCTTGCTCGCAAGGACGC | n/a | n/a | sooosssssssssssooss | 5-9-5 | 80 | 2496 |
| 665092 | 121765 | 121783 | CGCCTGCTTGCTCGCAAGG | n/a | n/a | sooosssssssssssooss | 5-9-5 | 82 | 2497 |
| 665093 | 121767 | 121785 | CCCGCCTGCTTGCTCGCAA | n/a | n/a | sooosssssssssssooss | 5-9-5 | 92 | 2498 |
| 665094 | 121769 | 121787 | GACCCGCCTGCTTGCTCGC | n/a | n/a | sooosssssssssssooss | 5-9-5 | 91 | 2499 |
| 665095 | 121771 | 121789 | TGGACCCGCCTGCTTGCTC | n/a | n/a | sooosssssssssssooss | 5-9-5 | 83 | 2500 |
| 665096 | 121773 | 121791 | CCTGGACCCGCCTGCTTGC | n/a | n/a | sooosssssssssssooss | 5-9-5 | 88 | 2501 |
| 665097 | 121775 | 121793 | ACCCTGGACCCGCCTGCTT | n/a | n/a | sooosssssssssssooss | 5-9-5 | 60 | 2502 |
| 665098 | 121786 | 121804 | AGTGACACGCCACCCTGGA | n/a | n/a | sooosssssssssssooss | 5-9-5 | 62 | 2503 |
| 665099 | 121811 | 121829 | CCTTTGGTAGCCAGAAAAA | n/a | n/a | sooosssssssssssooss | 5-9-5 | 53 | 2504 |
| 665100 | 121817 | 121835 | TCTGCACCTTTGGTAGCCA | n/a | n/a | sooosssssssssssooss | 5-9-5 | 84 | 2505 |
| 665101 | 121938 | 121956 | ACAGCACGGCGCATGGGAC | n/a | n/a | sooosssssssssssooss | 5-9-5 | 54 | 2506 |
| 665102 | 121940 | 121958 | CCACAGCACGGCGCATGGG | n/a | n/a | sooosssssssssssooss | 5-9-5 | 84 | 2507 |
| 665103 | 121942 | 121960 | AGCCACAGCACGGCGCATG | n/a | n/a | sooosssssssssssooss | 5-9-5 | 85 | 2508 |
| 664714 | 135820 | 135838 | TGACAAAAGCAGGTTAAGT | 2783 | 2801 | sooosssssssssssooss | 5-9-5 | 54 | 2332 |
| 664715 | 135821 | 135839 | GTGACAAAAGCAGGTTAAG | 2784 | 2802 | sooosssssssssssooss | 5-9-5 | 65 | 2335 |
| 664716 | 135822 | 135840 | AGTGACAAAAGCAGGTTAA | 2785 | 2803 | sooosssssssssssooss | 5-9-5 | 79 | 2337 |
| 664717 | 135823 | 135841 | GAGTGACAAAAGCAGGTTA | 2786 | 2804 | sooosssssssssssooss | 5-9-5 | 70 | 2340 |

TABLE 60-continued

| ISIS NO | SEQ ID NO: 1 start site | SEQ ID NO: 1 stop site | Sequence | SEQ ID NO: 2 start site | SEQ ID NO: 2 stop site | Linkage Chemistry Motif | % inhibition | SEQ ID NO |
|---|---|---|---|---|---|---|---|---|
| 664718 | 135824 | 135842 | CGAGTGACAAAAGCAGGTT | 2787 | 2805 | sooossssssssssooss 5-9-5 | 89 | 2343 |
| 664719 | 135825 | 135843 | CCGAGTGACAAAAGCAGGT | 2788 | 2806 | sooossssssssssooss 5-9-5 | 84 | 2345 |
| 664720 | 135826 | 135844 | GCCGAGTGACAAAAGCAGG | 2789 | 2807 | sooossssssssssooss 5-9-5 | 71 | 2348 |
| 664721 | 135827 | 135845 | AGCCGAGTGACAAAAGCAG | 2790 | 2808 | sooossssssssssooss 5-9-5 | 81 | 2351 |
| 664722 | 135828 | 135846 | AAGCCGAGTGACAAAAGCA | 2791 | 2809 | sooossssssssssooss 5-9-5 | 68 | 2353 |
| 664723 | 135829 | 135847 | AAAGCCGAGTGACAAAAGC | 2792 | 2810 | sooossssssssssooss 5-9-5 | 51 | 2356 |
| 664724 | 135830 | 135848 | CAAAGCCGAGTGACAAAAG | 2793 | 2811 | sooossssssssssooss 5-9-5 | 47 | 2359 |
| 664725 | 135831 | 135849 | CCAAAGCCGAGTGACAAAA | 2794 | 2812 | sooossssssssssooss 5-9-5 | 69 | 2361 |
| 664726 | 135832 | 135850 | GCCAAAGCCGAGTGACAAA | 2795 | 2813 | sooossssssssssooss 5-9-5 | 76 | 2364 |
| 664727 | 135833 | 135851 | AGCCAAAGCCGAGTGACAA | 2796 | 2814 | sooossssssssssooss 5-9-5 | 64 | 2367 |
| 664728 | 135834 | 135852 | GAGCCAAAGCCGAGTGACA | 2797 | 2815 | sooossssssssssooss 5-9-5 | 78 | 2369 |
| 664729 | 135835 | 135853 | CGAGCCAAAGCCGAGTGAC | 2798 | 2816 | sooossssssssssooss 5-9-5 | 74 | 2421 |
| 664730 | 135836 | 135854 | CCGAGCCAAAGCCGAGTGA | 2799 | 2817 | sooossssssssssooss 5-9-5 | 76 | 2424 |
| 664731 | 135837 | 135855 | CCCGAGCCAAAGCCGAGTG | 2800 | 2818 | sooossssssssssooss 5-9-5 | 75 | 2426 |
| 664732 | 135838 | 135856 | TCCCGAGCCAAAGCCGAGT | 2801 | 2819 | sooossssssssssooss 5-9-5 | 80 | 2429 |
| 664733 | 135839 | 135857 | GTCCCGAGCCAAAGCCGAG | 2802 | 2820 | sooossssssssssooss 5-9-5 | 70 | 2432 |
| 664734 | 135840 | 135858 | AGTCCCGAGCCAAAGCCGA | 2803 | 2821 | sooossssssssssooss 5-9-5 | 59 | 2434 |
| 664735 | 135841 | 135859 | AAGTCCCGAGCCAAAGCCG | 2804 | 2822 | sooossssssssssooss 5-9-5 | 58 | 2437 |
| 664736 | 135842 | 135860 | GAAGTCCCGAGCCAAAGCC | 2805 | 2823 | sooossssssssssooss 5-9-5 | 76 | 2440 |
| 664737 | 135843 | 135861 | TGAAGTCCCGAGCCAAAGC | 2806 | 2824 | sooossssssssssooss 5-9-5 | 46 | 2442 |
| 664738 | 135844 | 135862 | TTGAAGTCCCGAGCCAAAG | 2807 | 2825 | sooossssssssssooss 5-9-5 | 46 | 2550 |
| 664739 | 135845 | 135863 | TTTGAAGTCCCGAGCCAAA | 2808 | 2826 | sooossssssssssooss 5-9-5 | 56 | 2551 |
| 664740 | 135846 | 135864 | TTTTGAAGTCCCGAGCCAA | 2809 | 2827 | sooossssssssssooss 5-9-5 | 44 | 2552 |
| 664741 | 135847 | 135865 | ATTTTGAAGTCCCGAGCCA | 2810 | 2828 | sooossssssssssooss 5-9-5 | 61 | 2553 |
| 664742 | 135848 | 135866 | GATTTTGAAGTCCCGAGCC | 2811 | 2829 | sooossssssssssooss 5-9-5 | 59 | 2554 |
| 664743 | 135849 | 135867 | TGATTTTGAAGTCCCGAGC | 2812 | 2830 | sooossssssssssooss 5-9-5 | 64 | 2555 |
| 664744 | 135850 | 135868 | CTGATTTTGAAGTCCCGAG | 2813 | 2831 | sooossssssssssooss 5-9-5 | 67 | 2556 |
| 664745 | 135851 | 135869 | ACTGATTTTGAAGTCCCGA | 2814 | 2832 | sooossssssssssooss 5-9-5 | 73 | 2557 |
| 664746 | 135852 | 135870 | CACTGATTTTGAAGTCCCG | 2815 | 2833 | sooossssssssssooss 5-9-5 | 86 | 2558 |
| 664747 | 135853 | 135871 | TCACTGATTTTGAAGTCCC | 2816 | 2834 | sooossssssssssooss 5-9-5 | 76 | 2371 |
| 664748 | 135854 | 135872 | ATCACTGATTTTGAAGTCC | 2817 | 2835 | sooossssssssssooss 5-9-5 | 74 | 2373 |
| 664749 | 135855 | 135873 | CATCACTGATTTTGAAGTC | 2818 | 2836 | sooossssssssssooss 5-9-5 | 50 | 2375 |
| 664750 | 135856 | 135874 | CCATCACTGATTTTGAAGT | 2819 | 2837 | sooossssssssssooss 5-9-5 | 57 | 2378 |
| 664751 | 135857 | 135875 | CCCATCACTGATTTTGAAG | 2820 | 2838 | sooossssssssssooss 5-9-5 | 64 | 2381 |
| 664752 | 135858 | 135876 | TCCCATCACTGATTTTGAA | 2821 | 2839 | sooossssssssssooss 5-9-5 | 59 | 2383 |
| 664753 | 135859 | 135877 | CTCCCATCACTGATTTTGA | 2822 | 2840 | sooossssssssssooss 5-9-5 | 73 | 2386 |
| 664754 | 135860 | 135878 | ACTCCCATCACTGATTTTG | 2823 | 2841 | sooossssssssssooss 5-9-5 | 75 | 2389 |

245
246

TABLE 60-continued

| ISIS NO | SEQ ID NO: 1 start site | SEQ ID NO: 1 stop site | Sequence | SEQ ID NO: 2 start site | SEQ ID NO: 2 stop site | Linkage Chemistry | Motif | % inhibition | SEQ ID NO |
|---|---|---|---|---|---|---|---|---|---|
| 664755 | 135861 | 135879 | TACTCCCATCACTGATTTT | 2824 | 2842 | sooossssssssssssooss | 5-9-5 | 40 | 2391 |
| 664756 | 135862 | 135880 | TTACTCCCATCACTGATTT | 2825 | 2843 | sooossssssssssssooss | 5-9-5 | 43 | 2394 |
| 664757 | 135863 | 135881 | CTTACTCCCATCACTGATT | 2826 | 2844 | sooossssssssssssooss | 5-9-5 | 70 | 2397 |
| 664758 | 135864 | 135882 | TCTTACTCCCATCACTGAT | 2827 | 2845 | sooossssssssssssooss | 5-9-5 | 61 | 2399 |
| 664759 | 135865 | 135883 | CTCTTACTCCCATCACTGA | 2828 | 2846 | sooossssssssssssooss | 5-9-5 | 68 | 2402 |
| 664760 | 135866 | 135884 | GCTCTTACTCCCATCACTG | 2829 | 2847 | sooossssssssssssooss | 5-9-5 | 82 | 2405 |
| 664761 | 135867 | 135885 | TGCTCTTACTCCCATCACT | 2830 | 2848 | sooossssssssssssooss | 5-9-5 | 76 | 2407 |
| 664762 | 135868 | 135886 | TTGCTCTTACTCCCATCAC | 2831 | 2849 | sooossssssssssssooss | 5-9-5 | 77 | 2409 |
| 664763 | 135869 | 135887 | TTTGCTCTTACTCCCATCA | 2832 | 2850 | sooossssssssssssooss | 5-9-5 | 83 | 2411 |
| 664764 | 135870 | 135888 | ATTTGCTCTTACTCCCATC | 2833 | 2851 | sooossssssssssssooss | 5-9-5 | 82 | 2413 |
| 664765 | 135871 | 135889 | AATTTGCTCTTACTCCCAT | 2834 | 2852 | sooossssssssssssooss | 5-9-5 | 77 | 2415 |
| 664766 | 135872 | 135890 | AAATTTGCTCTTACTCCCA | 2835 | 2853 | sooossssssssssssooss | 5-9-5 | 69 | 2417 |

TABLE 61

| ISIS NO | SEQ ID NO: 1 start site | SEQ ID NO: 1 stop site | Sequence | SEQ ID NO: 2 start site | SEQ ID NO: 2 stop site | Linkage Chemistry | Motif | % inhibition | SEQ ID NO |
|---|---|---|---|---|---|---|---|---|---|
| 665041 | 73879 | 73898 | GTGATCTTCCATCACTTCGA | 345 | 364 | sooossssssssssssooss | 5-10-5 | 86 | 25 |
| 665044 | 98890 98927 | 98908 98945 | GTTTTCAAACACACCTTCA | n/a | n/a | sooossssssssssssooss | 5-9-5 | 90 | 2485 |
| 665201 | 102119 | 102138 | GGTTTGTTTTTAAACAATT | n/a | n/a | sooossssssssssssooss | 5-10-5 | 57 | 2509 |
| 665202 | 102144 | 102163 | GAACCCAATGAGAGTAGCAA | n/a | n/a | sooossssssssssssooss | 5-10-5 | 86 | 2510 |
| 665203 | 102169 | 102188 | TTGCCAAAATCAGGAATGGG | n/a | n/a | sooossssssssssssooss | 5-10-5 | 87 | 2511 |
| 665204 | 102194 | 102213 | TCAGGGCAATCTGGAAGCAT | n/a | n/a | sooossssssssssssooss | 5-10-5 | 79 | 2512 |
| 665205 | 102659 | 102678 | ACTCTCCACTCCATGTCAAT | n/a | n/a | sooossssssssssssooss | 5-10-5 | 26 | 2513 |
| 665206 | 102684 | 102703 | CAGAGCTCACAGCAATGATC | n/a | n/a | sooossssssssssssooss | 5-10-5 | 78 | 2514 |
| 665207 | 102709 | 102728 | TCAGCATGAGTTGTGCCAAG | n/a | n/a | sooossssssssssssooss | 5-10-5 | 91 | 2515 |
| 665208 | 102734 | 102753 | CCAGAGGAACTGTGTGCATT | n/a | n/a | sooossssssssssssooss | 5-10-5 | 79 | 2516 |
| 665209 | 102759 | 102778 | CCAAGTTCCCTGAGGACATT | n/a | n/a | sooossssssssssssooss | 5-10-5 | 13 | 2517 |
| 665210 | 112934 | 112953 | GTTGTGTTTTCTGGTTTATT | n/a | n/a | sooossssssssssssooss | 5-10-5 | 96 | 2518 |
| 665211 | 112959 | 112978 | TTTTTTTTTAAGTTAGGAGT | n/a | n/a | sooossssssssssssooss | 5-10-5 | 20 | 2519 |
| 665212 | 112984 | 113003 | TTTTACTGGTTGTGTTTTCT | n/a | n/a | sooossssssssssssooss | 5-10-5 | 90 | 2520 |
| 665213 | 113009 | 113028 | CAGCTCTTAATGCTGTTATA | n/a | n/a | sooossssssssssssooss | 5-10-5 | 90 | 2521 |
| 665214 | 113498 | 113517 | TTCAGCTCCTGCACCCAGCA | n/a | n/a | sooossssssssssssooss | 5-10-5 | 54 | 2522 |
| 665215 | 113548 | 113567 | TTTTGCTTTGCTCTGAAGA | n/a | n/a | sooossssssssssssooss | 5-10-5 | 57 | 2523 |
| 665216 | 115105 | 115124 | TTGCTATTAAATATAATGTA | n/a | n/a | sooossssssssssssooss | 5-10-5 | 35 | 2524 |
| 665217 | 115130 | 115149 | GCTTTTTAAAGTGACAACTG | n/a | n/a | sooossssssssssssooss | 5-10-5 | 78 | 2525 |
| 665218 | 115155 | 115174 | TTCCACATAAATGTTCTACA | n/a | n/a | sooossssssssssssooss | 5-10-5 | 93 | 2526 |

TABLE 61-continued

| ISIS NO | SEQ ID NO: 1 start site | SEQ ID NO: 1 stop site | Sequence | SEQ ID NO: 2 start site | SEQ ID NO: 2 stop site | Linkage Chemistry | Motif | % inhibition | SEQ ID NO |
|---|---|---|---|---|---|---|---|---|---|
| 665219 | 115205 | 115224 | CCCTGATTGAGGAGAGGCAA | n/a | n/a | sooosssssssssssooss | 5-10-5 | 77 | 2527 |
| 665220 | 116595 | 116614 | ATGTTTTTTTCTGGCCGGGC | n/a | n/a | sooosssssssssssooss | 5-10-5 | 85 | 2528 |
| 665221 | 116620 | 116639 | TTCAGTATCTGCCACATACT | n/a | n/a | sooosssssssssssooss | 5-10-5 | 64 | 2529 |
| 665222 | 116645 | 116664 | TGAATCAAAGGACATTAAGC | n/a | n/a | sooosssssssssssooss | 5-10-5 | 69 | 2530 |
| 664661 | 135820 | 135839 | GTGACAAAAGCAGGTTAAGT | 2783 | 2802 | sooosssssssssssooss | 5-10-5 | 78 | 2333 |
| 664662 | 135821 | 135840 | AGTGACAAAAGCAGGTTAAG | 2784 | 2803 | sooosssssssssssooss | 5-10-5 | 18 | 2336 |
| 664663 | 135822 | 135841 | GAGTGACAAAAGCAGGTTAA | 2785 | 2804 | sooosssssssssssooss | 5-10-5 | 79 | 2338 |
| 664664 | 135823 | 135842 | CGAGTGACAAAAGCAGGTTA | 2786 | 2805 | sooosssssssssssooss | 5-10-5 | 66 | 2341 |
| 664665 | 135824 | 135843 | CCGAGTGACAAAAGCAGGTT | 2787 | 2806 | sooosssssssssssooss | 5-10-5 | 94 | 2344 |
| 664666 | 135825 | 135844 | GCCGAGTGACAAAAGCAGGT | 2788 | 2807 | sooosssssssssssooss | 5-10-5 | 89 | 2346 |
| 664667 | 135826 | 135845 | AGCCGAGTGACAAAAGCAGG | 2789 | 2808 | sooosssssssssssooss | 5-10-5 | 29 | 2349 |
| 664668 | 135827 | 135846 | AAGCCGAGTGACAAAAGCAG | 2790 | 2809 | sooosssssssssssooss | 5-10-5 | 72 | 2352 |
| 664669 | 135828 | 135847 | AAAGCCGAGTGACAAAAGCA | 2791 | 2810 | sooosssssssssssooss | 5-10-5 | 53 | 2354 |
| 664670 | 135829 | 135848 | CAAAGCCGAGTGACAAAAGC | 2792 | 2811 | sooosssssssssssooss | 5-10-5 | 55 | 2357 |
| 664671 | 135830 | 135849 | CCAAAGCCGAGTGACAAAAG | 2793 | 2812 | sooosssssssssssooss | 5-10-5 | 58 | 2360 |
| 664672 | 135831 | 135850 | GCCAAAGCCGAGTGACAAAA | 2794 | 2813 | sooosssssssssssooss | 5-10-5 | 80 | 2362 |
| 664673 | 135832 | 135851 | AGCCAAAGCCGAGTGACAAA | 2795 | 2814 | sooosssssssssssooss | 5-10-5 | 52 | 2365 |
| 664674 | 135833 | 135852 | GAGCCAAAGCCGAGTGACAA | 2796 | 2815 | sooosssssssssssooss | 5-10-5 | 71 | 2368 |
| 664675 | 135834 | 135853 | CGAGCCAAAGCCGAGTGACA | 2797 | 2816 | sooosssssssssssooss | 5-10-5 | 76 | 2419 |
| 664676 | 135835 | 135854 | CCGAGCCAAAGCCGAGTGAC | 2798 | 2817 | sooosssssssssssooss | 5-10-5 | 78 | 2422 |
| 664677 | 135836 | 135855 | CCCGAGCCAAAGCCGAGTGA | 2799 | 2818 | sooosssssssssssooss | 5-10-5 | 77 | 2425 |
| 664678 | 135837 | 135856 | TCCCGAGCCAAAGCCGAGTG | 2800 | 2819 | sooosssssssssssooss | 5-10-5 | 73 | 2427 |
| 664679 | 135838 | 135857 | GTCCCGAGCCAAAGCCGAGT | 2801 | 2820 | sooosssssssssssooss | 5-10-5 | 73 | 2430 |
| 664680 | 135839 | 135858 | AGTCCCGAGCCAAAGCCGAG | 2802 | 2821 | sooosssssssssssooss | 5-10-5 | 20 | 2433 |
| 664681 | 135840 | 135859 | AAGTCCCGAGCCAAAGCCGA | 2803 | 2822 | sooosssssssssssooss | 5-10-5 | 64 | 2435 |
| 664682 | 135841 | 135860 | GAAGTCCCGAGCCAAAGCCG | 2804 | 2823 | sooosssssssssssooss | 5-10-5 | 60 | 2438 |
| 664683 | 135842 | 135861 | TGAAGTCCCGAGCCAAAGCC | 2805 | 2824 | sooosssssssssssooss | 5-10-5 | 64 | 2441 |
| 664684 | 135843 | 135862 | TTGAAGTCCCGAGCCAAAGC | 2806 | 2825 | sooosssssssssssooss | 5-10-5 | 52 | 2443 |
| 664685 | 135844 | 135863 | TTTGAAGTCCCGAGCCAAAG | 2807 | 2826 | sooosssssssssssooss | 5-10-5 | 45 | 2559 |
| 664686 | 135845 | 135864 | TTTTGAAGTCCCGAGCCAAA | 2808 | 2827 | sooosssssssssssooss | 5-10-5 | 56 | 2560 |
| 664687 | 135846 | 135865 | ATTTTGAAGTCCCGAGCCAA | 2809 | 2828 | sooosssssssssssooss | 5-10-5 | 67 | 2561 |
| 664688 | 135847 | 135866 | GATTTTGAAGTCCCGAGCCA | 2810 | 2829 | sooosssssssssssooss | 5-10-5 | 73 | 2562 |
| 664689 | 135848 | 135867 | TGATTTTGAAGTCCCGAGCC | 1644 | 1663 | sooosssssssssssooss | 5-10-5 | 67 | 56 |
| 664690 | 135849 | 135868 | CTGATTTTGAAGTCCCGAGC | 2812 | 2831 | sooosssssssssssooss | 5-10-5 | 73 | 464 |
| 664691 | 135850 | 135869 | ACTGATTTTGAAGTCCCGAG | 2813 | 2832 | sooosssssssssssooss | 5-10-5 | 85 | 2563 |
| 664692 | 135851 | 135870 | CACTGATTTTGAAGTCCCGA | 2814 | 2833 | sooosssssssssssooss | 5-10-5 | 89 | 2564 |
| 664693 | 135852 | 135871 | TCACTGATTTTGAAGTCCCG | 2815 | 2834 | sooosssssssssssooss | 5-10-5 | 75 | 2565 |
| 424880 | 135853 | 135872 | ATCACTGATTTTGAAGTCCC | 2816 | 2835 | sssssssssssssssssss | 5-10-5 | 62 | 57 |

TABLE 61-continued

| ISIS NO | SEQ ID NO: 1 start site | SEQ ID NO: 1 stop site | Sequence | SEQ ID NO: 2 start site | SEQ ID NO: 2 stop site | Linkage Chemistry | Motif | % inhibition | SEQ ID NO |
|---|---|---|---|---|---|---|---|---|---|
| 664694 | 135853 | 135872 | ATCACTGATTTTGAAGTCCC | 1649 | 1668 | sooosssssssssssooss | 5-10-5 | 85 | 57 |
| 664695 | 135854 | 135873 | CATCACTGATTTTGAAGTCC | 2817 | 2836 | sooosssssssssssooss | 5-10-5 | 83 | 2374 |
| 664696 | 135855 | 135874 | CCATCACTGATTTTGAAGTC | 2818 | 2837 | sooosssssssssssooss | 5-10-5 | 66 | 2376 |
| 664697 | 135856 | 135875 | CCCATCACTGATTTTGAAGT | 2819 | 2838 | sooosssssssssssooss | 5-10-5 | 58 | 2379 |
| 664698 | 135857 | 135876 | TCCCATCACTGATTTTGAAG | 2820 | 2839 | sooosssssssssssooss | 5-10-5 | 71 | 2382 |
| 664699 | 135858 | 135877 | CTCCCATCACTGATTTTGAA | 2821 | 2840 | sooosssssssssssooss | 5-10-5 | 32 | 2384 |
| 664700 | 135859 | 135878 | ACTCCCATCACTGATTTTGA | 2822 | 2841 | sooosssssssssssooss | 5-10-5 | 71 | 2387 |
| 664701 | 135860 | 135879 | TACTCCCATCACTGATTTTG | 2823 | 2842 | sooosssssssssssooss | 5-10-5 | 75 | 2390 |
| 664702 | 135861 | 135880 | TTACTCCCATCACTGATTTT | 2824 | 2843 | sooosssssssssssooss | 5-10-5 | 46 | 2392 |
| 664703 | 135862 | 135881 | CTTACTCCCATCACTGATTT | 2825 | 2844 | sooosssssssssssooss | 5-10-5 | 22 | 2395 |
| 664704 | 135863 | 135882 | TCTTACTCCCATCACTGATT | 2826 | 2845 | sooosssssssssssooss | 5-10-5 | 72 | 2398 |
| 664705 | 135864 | 135883 | CTCTTACTCCCATCACTGAT | 2827 | 2846 | sooosssssssssssooss | 5-10-5 | 70 | 2400 |
| 664706 | 135865 | 135884 | GCTCTTACTCCCATCACTGA | 2828 | 2847 | sooosssssssssssooss | 5-10-5 | 77 | 2403 |
| 664707 | 135866 | 135885 | TGCTCTTACTCCCATCACTG | 2829 | 2848 | sooosssssssssssooss | 5-10-5 | 88 | 2406 |
| 664708 | 135867 | 135886 | TTGCTCTTACTCCCATCACT | 2830 | 2849 | sooosssssssssssooss | 5-10-5 | 86 | 2408 |
| 664709 | 135868 | 135887 | TTTGCTCTTACTCCCATCAC | 2831 | 2850 | sooosssssssssssooss | 5-10-5 | 16 | 2410 |
| 664710 | 135869 | 135888 | ATTTGCTCTTACTCCCATCA | 2832 | 2851 | sooosssssssssssooss | 5-10-5 | 80 | 2412 |
| 664711 | 135870 | 135889 | AATTTGCTCTTACTCCCATC | 2833 | 2852 | sooosssssssssssooss | 5-10-5 | 65 | 2414 |
| 664712 | 135871 | 135890 | AAATTTGCTCTTACTCCCAT | 2834 | 2853 | sooosssssssssssooss | 5-10-5 | 60 | 2416 |
| 664713 | 135872 | 135891 | GAAATTTGCTCTTACTCCCA | 2835 | 2854 | sooosssssssssssooss | 5-10-5 | 85 | 2418 |

Example 17

Dose-Dependent Antisense Inhibition of Human Tau in SH-SY5Y Cells

Gapmers from studies described above exhibiting significant in vitro inhibition of tau mRNA were selected and tested at various doses in SH-SY5Y cells. The antisense oligonucleotides were tested in a series of experiments that had similar culture conditions. The results for each experiment are presented in separate tables shown below. Cells were plated at a density of 20,000 cells per well and transfected using electroporation with 0.247 µM, 0.741 µM, 2.22 µM, 6.67 µM, and 20.00 µM concentrations of antisense oligonucleotide, as specified in the Tables below. After a treatment period of approximately 16 hours, RNA was isolated from the cells and tau mRNA levels were measured by quantitative real-time PCR. Human primer probe set RTS3104 was used to measure mRNA levels. Tau mRNA levels were adjusted according to total RNA content, as measured by RIBOGREEN®. Results are presented as percent inhibition of tau, relative to untreated control cells. Tau mRNA levels were significantly reduced in a dose-dependent manner in antisense oligonucleotide treated cells.

TABLE 62

| ISIS No | 0.247 µM | 0.741 µM | 2.22 µM | 6.67 µM | 20.00 µM | $IC_{50}$ (µM) |
|---|---|---|---|---|---|---|
| 620887 | 18 | 39 | 71 | 88 | 95 | 1.2 |
| 664662 | 5 | 16 | 34 | 59 | 68 | 6.4 |
| 664665 | 16 | 41 | 69 | 89 | 96 | 1.2 |
| 664667 | 5 | 20 | 39 | 78 | 90 | 2.9 |
| 664680 | 7 | 11 | 21 | 56 | 81 | 5.9 |
| 664699 | 0 | 1 | 28 | 59 | 85 | 5.7 |
| 664709 | 8 | 16 | 48 | 66 | 89 | 3.1 |
| 665044 | 15 | 33 | 59 | 84 | 94 | 1.6 |
| 665205 | 0 | 7 | 35 | 51 | 86 | 5.3 |
| 665207 | 22 | 36 | 57 | 82 | 93 | 1.4 |
| 665210 | 15 | 47 | 74 | 94 | 97 | 1.0 |
| 665212 | 6 | 22 | 56 | 82 | 95 | 2.1 |
| 665213 | 0 | 18 | 57 | 78 | 93 | 2.5 |
| 665217 | 10 | 28 | 63 | 86 | 95 | 1.7 |
| 665218 | 10 | 31 | 64 | 85 | 93 | 1.7 |

TABLE 63

| ISIS No | 0.247 µM | 0.741 µM | 2.22 µM | 6.67 µM | 20.00 µM | $IC_{50}$ (µM) |
|---|---|---|---|---|---|---|
| 664718 | 26 | 34 | 60 | 88 | 86 | 1.3 |
| 664745 | 34 | 39 | 67 | 87 | 95 | 0.9 |
| 664746 | 15 | 37 | 60 | 87 | 92 | 1.5 |

TABLE 63-continued

| ISIS No | 0.247 µM | 0.741 µM | 2.22 µM | 6.67 µM | 20.00 µM | IC$_{50}$ (µM) |
|---|---|---|---|---|---|---|
| 664760 | 32 | 50 | 75 | 89 | 97 | 0.7 |
| 665044 | 21 | 44 | 75 | 92 | 97 | 0.9 |
| 665082 | 5 | 27 | 67 | 87 | 96 | 1.7 |
| 665083 | 17 | 34 | 67 | 85 | 97 | 1.4 |
| 665089 | 9 | 26 | 53 | 84 | 94 | 2.0 |
| 665093 | 11 | 57 | 81 | 93 | 95 | 0.9 |
| 665094 | 25 | 53 | 76 | 91 | 93 | 0.7 |
| 665095 | 20 | 33 | 63 | 89 | 95 | 1.4 |
| 665096 | 5 | 37 | 57 | 86 | 95 | 1.8 |
| 665102 | 8 | 36 | 61 | 90 | 96 | 1.6 |
| 665103 | 6 | 24 | 59 | 83 | 92 | 2.1 |

TABLE 64

| ISIS No | 0.247 µM | 0.741 µM | 2.22 µM | 6.67 µM | 20.00 µM | IC$_{50}$ (µM) |
|---|---|---|---|---|---|---|
| 620887 | 26 | 45 | 72 | 89 | 96 | 1.2 |
| 621013 | 26 | 49 | 82 | 93 | 97 | 0.7 |
| 621031 | 25 | 41 | 66 | 84 | 92 | 1.1 |
| 621041 | 26 | 55 | 70 | 89 | 92 | 0.7 |
| 621238 | 23 | 41 | 59 | 85 | 95 | 1.2 |
| 621251 | 33 | 56 | 74 | 88 | 92 | 0.5 |
| 664514 | 11 | 36 | 68 | 79 | 91 | 1.6 |
| 664516 | 16 | 36 | 64 | 82 | 94 | 1.5 |
| 664534 | 18 | 35 | 48 | 76 | 91 | 1.9 |
| 664775 | 24 | 30 | 59 | 79 | 92 | 1.6 |
| 664788 | 11 | 21 | 26 | 55 | 73 | 6.2 |
| 664799 | 26 | 37 | 63 | 79 | 90 | 1.3 |
| 664800 | 15 | 0 | 61 | 75 | 90 | 2.7 |
| 665047 | 43 | 65 | 82 | 95 | 98 | 0.2 |
| 665077 | 19 | 44 | 63 | 85 | 96 | 1.2 |

Example 18

Intracerebroventricular Administration of Antisense Oligonucleotides Against Human Tau mRNA in Htau Mice Selected compounds were tested for efficacy by ICV administration in human tau transgenic mice (Duff et al., Neurobiology of Disease 7:87-98, 2000).

Treatment and Surgery

Groups of 4 mice each were administered ISIS 613099, ISIS 613361, ISIS 613370, ISIS 623782, or ISIS 623996 with a 200 µg dose delivered by ICV bolus injection. A control group of 2 mice was similarly treated with ISIS 424880 and a control group of 4 mice was similarly treated with PBS. All procedures were performed under isoflourane anesthesia and in accordance with IACUC regulations. For mouse ICV bolus injections, the antisense oligonucleotide was injected into the right lateral ventricle of human tau transgenic mice. Ten microliters of solution containing 200 µg of oligonucleotide in PBS was injected over approximately 10 seconds. Tissue was collected 14 days after oligonucleotide administration.

RNA Analysis

On day 14 after the oligonucleotide administration, RNA was extracted from the hippocampus, spinal cord and cortex for real-time PCR analysis of tau mRNA levels. Human tau mRNA levels were measured using the human primer probe set RTS3104. Results were calculated as percent inhibition of human tau mRNA expression compared to the control. All the antisense oligonucleotides effect significant inhibition of human tau mRNA levels in several tissues.

TABLE 65

Percent reduction of human tau mRNA levels in hTau mice

| ISIS No | Cortex | Hippocampus | Spinal Cord |
|---|---|---|---|
| 613099 | 41.8 | 55.2 | 54.1 |
| 613361 | 69.4 | 57.3 | 72.5 |
| 613370 | 42.2 | 61.0 | 63.0 |
| 623782 | 62.2 | 79.1 | 70.8 |
| 623996 | 74.1 | 69.2 | 76.4 |
| 424880 | 50.3 | 53.1 | 55.2 |

Example 19

Design of Oligonucleotides Targeting Human Tau

ISIS No. 603054 was designed to target human Tau. The nucleobase sequence and linkage chemistry of ISIS No. 603054 is given in table 66 below. ISIS No. 603054 is a 5-10-5 MOE gapmer. ISIS No. 603054 is 20 nucleosides in length, wherein the central gap segment comprises ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in Table 1 below is targeted to either the human tau genomic sequence, designated herein as SEQ ID NO: 1 (GENBANK Accession No. NT_010783.15 truncated from nucleotides 9240000 to 9381000) or to the human tau mRNA sequence, designated herein as SEQ ID NO: 2 (GENBANK Accession No. NM_001123066.3).

TABLE 66

ICV in vivo study in hTau mice and WT C57B16 mice

| ISIS NO | SEQ ID NO: 1 start site | SEQ ID NO: 1 stop site | Sequence | SEQ ID NO: 2 start site | SEQ ID NO: 2 stop site | Linkage Chemistry | SEQ ID NO |
|---|---|---|---|---|---|---|---|
| 603054 | 135853 | 135872 | ATCACTGATTTTGAAGTCCC | 2816 | 2835 | sooosssssssssssooos | 57 |

Example 20

In Vivo Analysis in Mice of Oligonucleotides Targeting Human Tau

Oligonucleotides, shown in the table below, were designed to target Tau. Mice, either human tau transgenic mice "hTau" (Duff et al., Neurobiology of Disease 7:87-98, 2000; Davies et al. J. Neurochem. (2003) 86, 582-590) or wild-type WT C57B16 mice were separated into groups of 3 or 4 mice. Each mouse in each group of mice was administered a single ICV dose of either 300 ug or 200 ug each of the oligonucleotides in the table below. At 3 hours post injection, each mouse was evaluated according to 7 different criteria. The 7 criteria are (1) the mouse was bright, alert, and responsive; (2) the mouse was standing or hunched without stimuli; (3) the mouse shows any movement without stimuli (4) the mouse demonstrates forward movement after its lifted; (5) the mouse demonstrates any movement after its lifted; (6) the mouse responds to a tail pinch; (7) regular breathing. For each of the 7 different criteria, each mouse was given a sub-score of 0 if it met the criteria or 1 if it did not. After all of the 7 criteria were evaluated, the sub-scores were summed for each mouse and then averaged for each group. For example, if a mouse was bright, alert, and responsive 3 hours after the 300 μg ICV dose, and met all other criteria, it would get a summed score of 0. If another mouse was not bright, alert, and responsive 3 hours after the 300 μg ICV dose but met all other criteria, it would receive a score of 1. Saline treated mice generally receive a score of 0. Results are presented as the average score for each treatment group in Table 67 below. "ND" means no data. These results demonstrate that ISIS 613099, ISIS 613361, ISIS 613370, ISIS 623782, ISIS 623996, ISIS 424880, and ISIS 603054 were well tolerated.

TABLE 67

ICV in vivo study in hTau mice and WT C57Bl6 mice

| | Line: | | |
|---|---|---|---|
| | hTau | | WT C57Bl6 |
| | Dose: | | |
| | 300 ug | 200 ug | 300 ug |
| 613099 | 0 | ND | ND |
| 613361 | 0 | ND | ND |
| 613370 | 0 | ND | ND |
| 623782 | 0 | ND | ND |
| 623996 | 0 | ND | ND |
| 424880 | ND | 3 | ND |
| 603054 | ND | ND | 0.25 |

Example 20

In Vivo Analysis in Rats of Oligonucleotides Targeting Human Tau

Sprague Dawley rats were separated into groups of 4 rats each. Each rat in each group of rats was administered a single 1 mg intrathecal (IT) dose or a single 3 mg intrathecal (IT) dose of ISIS 613099, ISIS 613361, ISIS 613370, ISIS 623782, ISIS 623996, ISIS 424880, or ISIS 603054. At 3 hours after injection, the movement of 7 different parts of the body was evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; and (7) the rat's head. For each of the 7 different body parts, each rat was given a sub-score of 0 if the body part was moving or 1 if the body part was paralyzed. After each of the 7 body parts were evaluated, the sub-scores were summed for each rat and then averaged for each group. For example, if a rat's tail, head, and all other evaluated body parts were moving 3 hours after the 3 mg IT dose, it would get a summed score of 0. If another rat was not moving its tail 3 hours after the 3 mg IT dose but all other evaluated body parts were moving, it would receive a score of 1. Saline treated rats generally receive a score of 0. A score of at the top end of the range would be suggestive of toxicity. Results are presented as the average score for each treatment group in Table 68 below.

TABLE 68

1 mg and 3 mg IT bolus in vivo study

| ISIS No. | Score 3 hours after injection Dose | |
|---|---|---|
| | 1 mg | 3 mg |
| 613099 | 0.25 | 3 |
| 613361 | 0 | 0.33 |
| 613370 | 0 | 0 |
| 623782 | 0.25 | 0.75 |
| 623996 | 0 | 2 |
| 424880 | 2.3 | 6 |
| 603054 | 1.25 | 2.75 |

SEQUENCE LISTING (2584 sequences)

SEQ ID NO: 1 - DNA, 141001 bp, Homo sapiens
aatttataaaggaaaaaggtttaattgactcacagttcagcatgtctggggaagtgttaggaaacttacaatcatggcagaagagaaagcaaaccatcctttctcacatggtgacaggaagagcaaagcggggtaagccccttacaaaaccaccagatctcatgagaactcactatcacgagaacaccatggaggtaactgcccccatgattcaattacctcccaccaggtccctcccacgacatgtggggattatgcgaactccaactcaagatgagatttgggtggggacacagccaaaccatatcagaagcttaaccttctttggagcatgattattcagttgaacctaagttcagtagtcacccagttatgctgtcttcagctactattttccatatgtttctcaaacatctgatatatcacactggctagtgcactttcttccaccagcataccatctcaatttaccactttaacaattggactgccactttgtgtcagggactatctgtgctccaactactacaagtgataaggtcctcactgacagccagggagcaagtgatccagctctaaaactcaccttatcatctgctttcctagaccactcctaacaaccaactattctgggttgagttctccaagaggcagagagttcaggatacagaatgttgttttgtttttgttgttgttgctgttgttgtttgtgtgtgtgtttgggcttttttgagacggagtctcactctgttgcccaggtagaagtgcagtggcatgatctcagctccctgcaacctccacctcctgggtttaagtgattcccctgcctccacctcctgagtagctgggactacaagtgtgcgccaccacacccagctaatttttgtgtttttagtagaaatggggttttaccatgttggctaggctgctcccaaactcctgacctccagtgatccacctacctctgcctcccaaagtgctgggattacaggcgtgagccaccacacccagcccagaatgtttattagaatgcacaattaataccagaggcagtggggaaggaaggactgagcagaggaggaagttgagttgtgattcaacccaacaactgcctggctggcatggggagctctggagttaaatagggccatcagactttcccagtgtggggccaacatgactgggtctttatacccccacctctgtcagtcactcaacgtggtctccctgcaacaaggtgactcttgcagccgagacaatccctgaagggacagagggctgaagcctgtctgccaacagcactcccagtggctggaacaagtccttccctataggggaatctgggcggcacacctccatctccatgtccatcacatacgatatcacagacatttaaatattttgataactgtacataagagtttcctttataatcttatagatcttattttatgcatttgaaaatattcttctgagacagggcttttatcatattgccatagggtgccacgatataaaaaaggttaaatactctctgattcagaagtatccaatgatgacttctctctcatgcatttaattgaaaatctggtttttctccttctctgctagttctctacctctctccccacctcccacatcatagcctattcacatatgtctgaatctcatgatagacaagttcaggttcttttcccaggttctttttaccacatccccccacccccacataaaaagtatatatggcacagcctaggttccacccaaatcctttctcctcttcttcctgggcccacaactctcctacatacattggtataccttgcgcttagggatggccatgtgactaagttctaacagtggaacatgatcagatgccacttccagcctctaagacagccagtgtgtttcctccataagctccttctcttcctcccaactggagactctaaatgatgaccctgcctcaagcaagcaaacaacaagtccctcaggggtggtgtaggctgcaaatggaaggagcttgagtcccaaaccttccacggagaaggctggctaccaacctggatcactcacccaagactgctcgaagagttggtttgaaccattgtgttttggggtctatttattacaacagtttagcttgctttgtgaatagatttagtggcagagcctccaaattctatagatacattgatctcagtcctaaccgcatctggaacaccattaaataaaggaattgcaaacccagagaaggtaatgaatttgtctaaggtcatacaagatggctaggatcaggacccaactctccagttttctttcttctctgctattctgccttctgtgatcctacataagtgggcatgattgtataacatatgcggccatgagatttctctttcagcaagagaaagggacaggaagaaagagagggaatgcattttcttggcctgaattagtgtgagccattagttacctacattgactaaattatctggaatgaacattcaactctacatcacatatagttaaaatgacagatctgcttaagattgtttctagcatacgttatttcaatttaggcaaatgtgaccattcagtgtgaggggaccatactgtcattaggtccctgtcagttctcaattatactgttatcttagagggggaaaaatgtgaaatttgaatgtagacgagtgttgatttgactgctacagtttattttacgtatagaaataaaataatgtgtagcaaaagcattattacaaagatgataatgaaataactagtatttataatagtataatagtatagtatttataatagtatgatagtttaatgactatttgtcagatgttgtgtaagaaactttatacacacacacacacacacctcatttaattcctgtatcaatcaggatacaggacgctgtggtaacaactcctcaaatctcggtggcttgcacaacaaatgcttatttcttttttttttttgacaccaagtcttgctctgtaacaggctggagtgcaatggtgcaatctcggctcactgcagcctctgcctcctgggttcaagcgattctcctgcctcagtctctcgagtagctgggaacacaggcacgcgccaccacatctggctaatttttgtgattttagtagagatgggatttcaccatgttgctcaggctggccttgaactcctgacctcaagcgatccacccacctcagcctcccaaagtgctgggattacaggcatgagccactgcgcccagccccaaatgtttatttcttgctcatgtgacatgtacttcctcgagtttttccttcctgagatctaagctgaaggaacagctctctggagccacgccattctggtggcggaaaggaagagtaaaagtggtagaaccttgcaatgctcttgaagcgcctatttggaatgtctacatcatgtaaatggtaatggacaagtatgtataatccccacaccaaaaaaaggggacactattggggacaataaccacatttcaatgctgcaagacggatattgactgcacccccttcccactttcagaaagaagaagagtaattttgctgaactccttctagagactggaaatgtcccttccagttggggtgattagggaaggctttggtaaaatttgagctagagtttgaaggttaggtagactactggtgggtgaagaaagaacaaggacctttgtaggcaaaggaaaacctcagaattacagaggtggaaaaagagttctagtcaagccacttcagctggctacagagtaggtgggaaagaaaatgggaggacaagggctcagatgatggggggttggggcattggggggacacttgaaagctaaactaaggggttgaacttaatttaggaggcagttagaagcttttacatatttttgagcaagagagtgacataattaaaatgatctgggccaggtgtggtggctcacacctgtaatcccagcactttgggaggctgaggagcttgggtcacctgaggtcaggagatcgagaccagcctggccaacatggtgaaatcccgtcctactaaaaatacaaaaattagccgggagtggtggcatatgcctgtaatcccagtagctgggaggctgagacaggaaaatcgcttgaacccgggaaacaggttgcagtgagccgagatcgtgccactgcactccagcctgggcaacagagcgagactccatctcaaaaaaacaaaacaaacacacacaaaaaaccaaaaataaataaataaaatgatcacttctgaatactgatctaactaggggttgcagggtgggctgatatagggagaaactggagagcaaggagatcactaaggtccctacatgtccagaaccaagatagaggtcttgaactaggatggtggcagttagaacaacaacaacaaaaagtcaattccaggctgagtgcagtggctcatgcctgtaatcccaacgctttgggaggctgaggtgggagttagaaagcagcctgggcaacactgcaagacctcctctctaaaaaaaaaaaaaaaaaaaagttagccaggtgtggtggtgcccacctgtagtcccagcaactcagaaggctgaggtgggaagattgcttgagccccaggagttcaagcttgccgtgagctacgattgtgccactgcactccagcctgagcaagaccttgtctccaaaaaaaggtcaattccactgacttttctaaggtgtacaccatcaaggggcagctccatctccaggccattggctcatgagacattctgtagtcagaaggctagggcagattgctttgagcaagcccccatggtggttctcactcctacttctttgggtatatgcccctctgtttaaaaataaagttaatatgcatttaaaaaaaaaaaggagaaaaaggtcagttccagaaactgtgtgaataaagcattttacttgctttttctattaatctataacatatgttgattttttaaaaagaatataagagctatgcaaattggagcttcaagacaacttcccatctccctaggaggagatggctgccctaaacccccctacatagaaatcatcccactgcttgggcttaaacttgatgttggggaaatgaaaaatccaagctaaggccgaagcctggggcctgggcgaccagcagaatgaggaccactggtcagtttcaggctgaggtgcgtcttccaggggacaatctctagctggcccttaaacattcagacttcaagctctatttacagcataaaggtgtttcaaaagacgtgatacaaataactgcaaatgctctgcgatgtgttaagcactgtttgaaattcgtctaatttaagatttttttttctgacgtaacggttagattcacgtttctttttttttaagtacagttctactgtattgtaactgagttagcttgctttaagccgatttgttaaggaaaggattcaccttggtcagtaacaaaaaaggtgggaaaaaagcaaggagaaaggaagcagcctgggggaaagagaccttagccaggggggcggtttcgggactacgaagggtcggggcggacggactcgagggccggccacgtggaaggccgctcaggacttctgtaggagaggacaccgccccaggctgactgaaagtaaagggcagcggacccagcggcggagccactggccttgccccgaccccgcatggcccgaaggaggacacccacccccgcaacgacacaaagactccaactacaggaggtggagaaagcgcgtgcgccacggaacgcgcgtgcgcgctgcggtcagcgccgcggcctgaggcgtagcgggagggggaccgcgaaagggcagcgccgagaggaacgagccgggagacgccggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtaagcgccgcggctccgaaatctgcctcgccgtccgcctctgtgcacccctgcgccgccgcccctcgccctccctctccgcagactggggcttcgtgcgccgggcatcggtcggggccaccgcagggcccctccctgcctcccctgctcgggggctggggccagggcggcctggaaagggacctgagcaagggatgcacgcacgcgtgagtgcgcgcgtgtgtgtgtgctggagggtcttcaccaccagattcgcgcagaccccaggtggaggctgtgccggcagggtggggcgcggcggcggtgacttgggggagggggctgcccttcactctcgactgcagccttttgccgcaatgggcgtgtgtgtgtgtgtgtgtgtgtgtgtgtgtgtgtgtgtgtgtggaggggtccgataacgacccccgaaaccgaatctgaaatccgctgtccctgccgctgttcgccatcagctctaagaaagacgtggatcgggttctagaaaagatgactccctgcacgcccctccctgcacctcccgagcagtgattccgacagggccttcactgcccctgattttaggcgggggccggccccctccccttttcctccttcagaaacccgtaggggacatttgggggctgggagaaatcgaggagatggggaggggtccacgcgctgtcactttagttgcccttccccctgcgcacgcctggcacagagacgcgagcagcgccgtgcctgagaacagtgcgcggatcccactgtgcacgctcgcaaaggcagggttcacctggcctggcgatgtggacggactcggcggccgctggtccccgttcgcgggcacgcacagccgcagccacgcacggatgggcgcggggctgcaggtgcatctcggggcggatttctttctcagcgctcggagcgcagggcgcccggcgtgtgcgctccctgccggaggcgcggggctggcgcgcagggctcgcccctcactgcggcagtgggtgtggaccctggtgggcgaggaagggggaggataggctgtgcctcctcccactcccgcccccagcccccctttttttccccctcggaacgcgaggtgccatcttttttcggcgtgtcacgtctttacggtgccatgccaaaccgggtggccgggcttcataggacagggcggggcctggcattaaagggagggggacaatcagcgctgaaatcttggcgttttgctgctgcgggcgtgagcactgggggcgttcgcccagcaccttcttcgggggctctttgctttgtctgtagaggttacgtgatctgcgctcccagccctggtttctggcttttattctgagggtgttcagtcaacctcccccctacgcccatgcgcctctctttcctttttcgctcctcatttccgagcccattgttggatctcgaggcttgctgggttcgatgaactcgagtcaaccccccgacccccggcacgcatggaacgggcgtgaccgcgcgcagcctcgtctcggagtctgccggcgccgggaagcttctgaagggatgggattcgagtctccgtgcgcgctgcgggcggcggcagagggatctcgcccctccctacaccccaagtgtcctgagggccacgccacaccaggttgcccagcgagggacgctggctacccatccggggatgggtggggagccctggcggggcctctccggctttacgccctgttgcttcgcctggccggagaatgtgaggaaggggcataaggttactggtgcttcggccacacccatctttctgagcccactggactgggcgcagaggggggattgccatggaaaccacaggtgtccggagaggggatcttggggctggcctcaccccttccctgcggagattggggaccctggggtagggggagccgcgcccagtcggcctcctggaggacacgggaggaagccccgaacccccgcgcctgaggctgtttctgattggcccctggaggccgcagacacgcagataggcggccctgggtgtatttttattaatattatgtccgtactgattaatattatttatcttaaataaatttcacccgtgtccaagttcaccgcgcccccaaaaccgagtctggggcggcagggggaactcctggccaacgaatccatgcctcgccctcctgtgatgaacctggtacgcacggttttctggttaattctatcgctgaaaactggtgcggggggcgcacttctgagacggaagagcatctaggagctgaatcctccacgcgggtcgcccaggttgatctgaatttctggggaatggcttggctgcccgcccgggaccaggccgaccctccttgacggtggcgtagagggctggagcctgggtactgcgaggctcctcgcatggctgggcccgccgcgaggggttgcagagcggctcagggatcgattcaagcatcgtctctcctccctcgcccccagacagagctgggcgcggggttccccttccagatggagcgagggtctcggggtggccccggaaaaggggagcccgcggccacggctacgtattgccatctcgcgagcagagatgtcacctcctgcctttggaggaaagggagcccggtggggatgagcgcatttagcccaatgctgggaacaaagcgcactccgcgcttctgcgatttcgctccattttgaaatgtgttggcgctttggtggggccgctgcggtgggcaaggccgggggcgctgttaatggaggaacctcagggggacggtccttcgtaggaaactctatcctggctctgcgcgcgctttaaggaaatggcttccctccaggacctcgagggatgcagcttttgcgcggatgacggtggggtgctgaaccagccggtgcgcctctggaaatgtctgggcacggatcctggggccatcgacgactcctccccattcccagcaggcgggagctcttacattccgagcgagtgacccctctcaccctctggcgctcacacacctgtaactccaaacctccgtctcagaatggtccaggctggaagggatgatgggggctccgacagcgactgcctagctcacccctctgcgtgctcaggctccaggctcagcaggaccaatttgagttctatctgatccccctcggccccttaactgacccatcctacaggagacagggaaatgtctttcctaccgcggttgattctggggtgtcattttgtgttttgtgatggctgcttatatttactgtataagcattgtatttactgtataagcattgtattataattactgtataagctgcttatatttactgtataagcatctccaaatcctccctctacgtaaacaaattaatggataaacagataagtgtatcccctgcccccacccctgctacgcaggtccggagtgactcttgaagctcatacattccttggccaagtttgcttctctaacagatgtttatatagcaataacctggcttggctcttgggttcacctttggacgatttggggaaggggcttgttggctttgctgggttttggatgagtgacagtccatgactgttcctgctggaagggcgtgacttttaagtggtttctaatatcaggcattgctcctccgacaggaacaaaagaaatggatactgcccataaattgttagaaaacttagaatcgctttgattgaggaaaggttagatttattccggttggaaaaagtggcctttctattaaacgtgccctttgaccctcatgcccttggaggtcggtgccagcctggagatgggataagattgtggttttccttctgcctttttaacatctgttgttacagtccatttgttgaaaatttaaagaaactgttttattccactttccctcagcatttatgtgtgtggtttcagtagctctgtggctatatgtacgaacacgtgttatttttccaattggacatgtgataattttccaactggaccttgccttctattgatgtatttatttagcatcttccttactccctccttgaaaaagaatcactcaaaaacaaataaaaacagccgtaggggcctaatacagtgctagacatacaagaggtattcggtccataccaaatggattttatccatgaaggataaatggggaaatacagtgggaagcaggtgggaaactgcgtttgactctgctctttcctccaccaccactttcctcatcaccgtgttcagagacccccaaagccccctcacactcccagaaacacccccctggccactcctaacttgccatgcccaggagttaggtgcttccactagtgacatggagctggcgtttggggggcacctcagcaggtgacgggaagagaagaccccagcctcaccagctgggctgcagcagggagaggagtcctcatgttccagcagggactctcagctgttttcctgtaaaaccatggttctcaactgggggccactgagatgtctagagagatgtttttgttttcacaactcggggagggtgctactgacatcttgtgggtagaggccaggaatgctgttaaacatcctacaaggaaggcacaggacagtctcctacatcaaaatatgacccagtcccaatgtcaccactgctggggttgacactggcactgctatcttaattacattcattgagtgtcttttaggaggccctattctaagtgcttgctaagattatctcatttaatcctcacaacacttccgctatgtagcaggtgctgttattatctccgtgatggggaaactgaagcacagagagggttagtaacttgctaaaggtcacagagccagtgggtggtggagctggttgcctgacactagttccctcccctctcagccacatgtgggtttacttggccattgtggactagtctgggaacccagatatgatctataacattgacccagtagaatattgattccaaaaccactgtctcacaaatgaatttttacaagagtctgtaatcggagcatgacccagaataaggttagggagatgtggagttaaagctctcaatttcttatctggccccgacacagagagcaaggcatttcactctacattggtgctctgtttataaaacaaagagcaaatatctcttcctaaggtccttaaacctcttcccccaatccagggtttctggactgctctgccatatgacggggcagctggtttgattgacccagggaaggctggaaatcaagactgggggatcaagacgtagattcagtgtggccaaggtcaagtctctgaggtttagggacatcagatccccagcttaggttctgtacctcggcaaggtgaaagcgttggcgcccactgatgaggcctgctctgagattgtgggtgtgggttgagttgggtgggcataggcaagtcctcttgtaagaatcttttggcaaagatgggcctgggaggcttttctcacttcctggggcccaggctttgcaataagtattccattatactgtggtaccttggggctacctgagaatcctctgtctcgcccctgttgccttgccaaagagtttgctgtccaagaattcctttcctgtctccaggtgccatgctcctgccacctctgccaggttccctgcctgcccagatggctcccaactgagtgtgaggaggaatttgagacaggttttgagctttctgggttctccagttaggaaactttctgtaagcatgcagatagaatgggcttcagcaaaatacaaactcgaacaacttccatgtatagtcccttaattttctttgcttttttcatatttcatcaggctccatgctgagcccaatcagggacccgatagaaatccaaacaccatgtcagcgagtccccaagaaatgcattttgtgccaaggctattcaaggaaggtttgggagcagctcaagggcagacactgttaccctcccccaggtccccagtgcagggcagtgttctgcatgtggaggcagtttggcctaatggttaaggaggtaggctctgatcgggcctcctgggcacaaatcccagctccctgctcactgtgagacctaagccatattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgtcctgtggatgagtgcttgtgattggctgaatgaccagaggggtctaaagatcctggtgatggaatcagttgtacagataaattgttacactgagtagggatcaagataggaaaagtcggcaactacccagctcccctgcaccaaactgggcagaagtggatcctctgaaaattgcacacacccatgtttaaatgtacacacagaactcttgccacaggcaagcggagatttgtcatctgctgtccctgcctcatcttcttcctgaaatccactccatgccaggaataaactgcatgctctccaccagcccaaactgacctgccttcccgccagccatcccgggcagggtgacctggcttagtacatcgggttcagagatctttccagtttactcgttgaataaaaagtgagggctgatcgagaaagtaatggcagtcagggaaggcgaaggaggtaaagaagagattttacaaatgaagtaattcaacagagtgctgacattggtaaactggcaaacagatttcagggtggttggttgagagtagagtagaaaaggattaaataaagcaaacttgtggtgtactgaatcttaggaattccatgtatccaataagtatagtcatttatgaattaataaattcggcctaagaagccttcttatcgcttaaatcaagactaagtaacaatatatcagttttaaaaagtcattatatcagaaaatcatttaaatgatacacatagatttccaagattttactttaaccgaaactatataaatgtgaatttgttcacccatcttttgacacagggctcaggtcttctcttggtgtctggatcagccagttgaaatttcttgtctgttttgcctatgccacattaataatgcactgtctgggtcctccgatttcagtttggattttgggtttacattgtggagtcatctgaatgcagaatccttcagggattttacttttttttttttttttcatggtctttaccatcccatttgatagtaaatattactcacctttatgaagtctttccaaaacattcaactaaattttcttaaaatcattgaatgatttgaagagcttattcctcagcacttttactccatcagcttgcaccttattttttaatctttttttgagacggagtctcgctctatcgcccaggcttaagtgcaatggcgcgatcttggctcactgcgacctccacctcctgggttcaagcaattccgcctcagcctccgccgtagccgggactacaggtacacaccataatgctcggctgatttttgtatttttgtagggatggggtatcgccatgttggccaggctggtcccgaacttctgacccaagtgatccacccacctcggcctcccaaagtgctgggattacaggtgtgagccaccgcgcccggccagcttgcaccttatttaggatatgtgattattatagcaagtctggtgtacatacaagattttgaatgggcacagatgacctttagtaagtgcttggctgtgataagaggcagtcctgactgcagatcaggctgtgtggaccccagccttgcatgtttacagaccttcatgtcttattcttacagggtatcagaagaacacctactggggaaacttataaattagtaaaaggtgggcattctccccgcccatcttctgtctgtctgccaggactagcacagcactttgaagtcattcacatagaatcccaacttaagagggtaaaatcctcctcaacagactgaaaataagtttaaattccctttgctatattaactcccctgaggaaagagtcttagatcaatgtccaacactaaaaacagttttaaatcagcaagtgagaattaaatctgaagcaattgataataatgtttcattcattcctctcctttggccccgtccaccctactgctaaatccaggcatcaaagagaagagggacataattatctctagtcccagctgctggttttccttccagcctatggcccagttttctgttttactgagaaggctggtgatgttatcttgggatctaagtctgcagtttcaccacaaaaagtccagggatgcactttcatgcttgtgtcctcctccctgggatagcaaggatattagaagacccctggctctgtaattgcttgtcatgtgctctacagacgccacagaatgccaagaacgaagtgctgggaaggacaaattcatggaaccgtgggacggtgctcctcccccagcgtaaaggacagctcctcctcctgaattggagccagcgttctaaatcatgtgtcaacagagttgtcctggatcggatccagttctgccattgatttgcaggtcatttcagtggtacctgtttccagttgttcttaattgaacagtggcaccaaactattgtcttgcctcatccccctcccatggcctgtcccccaaaaagagacttcttgggtaattaatcagggcaacatcaggcagtctgggcgcggtggctcacgcctgtaatcccagcactttgggaggccgaggcgggcagatcatgaggttaggagattgagaccatcctggctttgtgaaaccccgtctctactaaaaatacaaaaaattagccgggcgtggtggcgggcgcctgtagtcccagctactcgagaggctgaggcaggggaatggcgtgaacccgggaggtggaggttgcagtgagccgagatcgcaccactgcactctagcctgggcgacagagctagacttcttctcaaaaaaaaaaaaaaaaaggaatctctttggttttatatatattttttttatatatataatatatattaaaatataatatatatatttatataatataatatataaatatattatatattatatattttatatattatatattatatatattatatattatatatttatatatttatatattatatatatttatatattatatatttatatatattatatatttatatataatatatattatatattatatattatatattatatattatatatttatatatattatatattatatatattatatattatatatttatatattatatatttatatatattatatattatatattatatatttatatattatatatttatatattatatatatttatatatattatatattatatattatatatgtatatattatatatgttatatattatatatatttatatatataatatattgtatatattatatatctaatatattatatatattatatatattatatattataatatatattatatattatatattatatatatttttatatatataatatgtataatatataatatatataaaaacatatataatatatattatatattatatatatattatatatattatatatattaaatatattttatatatattatatatatatacacatatatatatataaatgaggccaggctcggtggctcacacttgtaatcccagcactgtgggaggatcacttgaagccaggagtctgagactagcctgggcaacaaaacaagatcctgtctctacaaaaggaaactgtaaaaattagctgggcatgatggcatgtgtctgtagccctagctacttgggaggccgaagcaggaggatcgcttgagcccaggagttcaaggctacagtgagctatgattgtcccatagcactccagcctgggtaacacagcaaggccctgtctctaaactttttttttttaattctatttatatttacatgtatttaaatgtgaatattcactacctatttgttgcatgcctgcattttttatactgggcttgccaaaaacccgaacagctttctactttgacaatgtatcagaatttaaatcagcaatatgttaataagccaagcaaaggttatatatgcaaataaaactgttgtctataacctcctgttacactggggcacagcaaaagtcatggtgtagtcgcatgtgaacctgtccctttcatagctgctcattgccaggaaacatcaggaatagccatttggaagagtcatcagccctcccaccatccgttttctgtcttgtcttttccctatgagcaggggaaattccacgctggccccaatccccagtgcagcggctcagcctctgcctctgctgctggtccccatgaggccagcttagaaacggaggattttgcagaacatccctaaatccgcttgaataatgaagtgatcattcataaactcacctgaaccttattaaaacctatttaatatttttcctggataatcctatagggataacttgcctcctgggcttctctccaccgggttcagttcttcctttagtggtgaagttcctcccttcttagcatctcaactgtgcctgagaaaaggccagtggcggctgcactctgttccctgtggagtgttaataaagactgaataaattgaaataaatccctttcaatgtcattaagtgctataaataatcatgaaccaatgttcgatggctgatgagaaatgcaagaaaaaatttttaatcagtaggattcataagttgacaatctgggccaagttaaaaaaaataaaaataaaaagacttttaaaaagatcttatcgtttgttaccagtaagactgaattccagaagcaagctactccctcatttgtgggcccctgttatcactggctgcttagggttgccaagccctgaattcatttgtcaactaagagatttttggccaagattaagatttcccatgcctccatatttccatctgagaaatggagattatactgtcttccccctcagaatggatgataatgtggtctctcttctgttcgcatagtcatagaactgaaataaaacaacttaagagaattcctttgagcttctcagaagtgctgcagggctgggggatgcctcccaggagccgcagtcaggtgctgatctgaagtctttggtgggctgactttagcctgacctgaaatagtatagctgctgccacctggctcccttagcgtcagtcagacggtgcagctggttcctaggggtgagggctgagccagcagggtccgtgcccaggagggatgcatgggtggccacagcccagcctgcactgatcttgtctgtccccttctttggaaggaaggagccccaaaccagggtgcaagacagtgggtgggggtgccttgagcatgacctcaagtgatttccagcccctgccagtgctgacttctctggggaagggctgggacttccttctgggctcaagtcacgacccttggatggaatttcctgggagcttttctgttttttctggagttttcagttttttcctaaccagacagggacttggtacagaatctcatattctaattatgcctaggagcagcctctccccaccactcacagtgtttagcatgtgacaggaatcgattaaggcatgagtgattaaattaaagccaggcattgacttggatggtgtaatattctgacatctgtttggtgtcaaaggcacggggcaggcgcgttaattgaactgcttgcacctggcatttgaattgagccagagcggggctaaagtcagtttgccttcaccctgtaaatggagggtttctccggagcgtggatggtgggaggtatttcagggtgtatgcataacccccaccctgacaatggcccatctcttctccagcgtggccaggtttgagtgccagtcctgggtgtccagtggccccatagccttgcgttttagtaaaatgctgcccccattaccacctggtctgtgcacttcggtcactggaatttgccatcttccagtcccgaatgtggcaagccatggagccttaagctcttctccctccacatcctggaacagacccgccagtttcttccaggcattgcctcagtttgcccctctgtttccagtcacactctcaccagcgataaaatgattttagaccttatcatctcaccctcggatccttatggaaacaataatgagttgttccctgtttcaattccaaaattcatatccaatccgttttgcatgccattgccaaattcctcccagagcaaccccgtcacctgccctggccctctccaagtgtggtcctgccatgggcatcgcctgctaagccaagctggcctcgagctgcctgcccgggtccccacaccttggctcacctccctgcccagtcccgcctcctgccagcctgccctgtggctccttcatagatgccgtgctctttctgccccttgctcacccatggcagccttgcccctctctccctgccccaccccctatttaaattgacctgaccttcctcagtgtccatcttccccgaagctttccccagccttggcactcaaggtccagaggctacgcgtttcctctcacctgtggcagcgccgtgctccccagtgcctcacagtttccttcttgcccccgcttcctgtgtaggactcatctgcccacaggttgcacgtcctgtgagggcaaggactgtgtcttatgtgactttccttctccagtcacagagctgggcacatagatagctcaaaaccctctttattaacacagttggatgttgagaaatcaaacaggccaatgtcaaatgagctctccttatttaaatcaagtcagttctccacctcctagcactcagttccagtactctatatacatggaaataataaaaaacacatttcctttgaaacattctataatcgttcctttgccctacttcagaccaacttaacgcactccccattggtccaaatgagttttgctatacgaagatgctgataataatagcagcagtggattattctgctaaaaccattgcctcgttaatcctcagtcccgaggtggggattattatcctcattttgcagagaagcaaactgagactcagagatttcacagctggggagggagccagctcatccctctgtccaggcccaagctctctcccgcttgccttcctgcctctgcaacctcagagcatcccccatctggttctactgcctgtgctagtcgtgcaggagccaaaagacacgtctttagtgctaaggactggagaagccatgccctccagcctctgtgaatgggtcatatgtaacatgagcctggagaaattatttgaaaccaaaggcaagcctctaaaccaggctgctgcttcatggcgccggtgacggcagaaccaaatttagtgctgtgggcaggtccacacttatcaaatagagaagctcatttttcttccggctcacatcaagcatgaaaaatgttcacacataccccccacacacacatgctttccggaggggtccatgtggctagaggctggaagatgtggatgagaggagcctggcaggtaagcccagggaagatgacattcagcttcccagacagcatctacagggagaaatttaattaaaagtggggcggtttccctgagcaaggcagacaaagtcagccctctactgttaagaaaaagggtcacagtgagaggggaggtgaggagactgagtctgtattttctagtctgttgggctacactacctgatcccccttcctcaaaaatccactttactttccccatgtctacaccaatgtggttcacactctgggaccaggaaaagggggagtgatggggaacagagaagggaggagctcacacagctgaggctggggttatgcatatcgaattacttagaatttgcaacctcacagggtactttcatggcgttgaaatacacttcccacagccaccctccctctaactaaaagcaagagtcatttctcagttctggtcttgcctcccacgttctcctccacatttaagaaaatccaccagctacaaagtgaagataccatatgtgatatcccaccctagtttctgttttatcagggtttggagcaggtggagcaggcagagggatcatttcagcctataaattgtattaagggtgagtactgagtcattcttcaagaaaagttttagaagcatccaaaactgaagggtggagccacctggagacagtatcatcagtcctggccccgagcatggcctgcataggcccccatggatcccagcgggagctgcagagtgcgggcaccttggcacacagccctgagtgcaaaattaggagctgggcagagggcatctctctgtcgccattgggcagcccagggcacactggtcatagccttagaccacgaacaccctgtgcccgggggacagatgcaaccagtgtgccctgggctgcccaatggcaacagagagatcgacacctggaccccatgtcacggggactccactactaaggctcctaagactgccaccttccagtgggataagccctgcctcctactgggcccacaatgtgcagagaacacttgggactacctggctttctggatacacaaatattgatccaatctggactaattagaaggtcagtcccaataacaaatcgaagtcagctgggcgtgatggctcactcctataatcccagcactttgggaggctgaggtgggcagatcatttgaagccagaagttcaagaccagcctgggcaacatagcaaaaccctgtctctactaaaaatacaaataattaggctgggtgtggtggctcatgcctgtaatcccaacagtttgggaggctgaggcaggtggtcacctgaggtcaggagtttgagaccagcctggccaacagggtgaaaccccgtgtctactaaaaacataaaaattagccaagcatgatggcatgtgcctataatcctggctactagggaggctgagacaggagagaatcgcttgaatccaggaggtggttgcagtgagctgagatggtgccactgcactccagcctggttgacagagcaagactctgtctcaaaaaaaaaaaaaaaaaaaaaaaagccatgcctggtggagcactacgtgtaatctcagctatttgggaggctgaggcacgagaatcacttgaacctgggaggcagtggttgcagtgagctgagatcgcgccactgcactccagcctgggcgacagagtgagtgagactccatttcaaaaaaataataaatctgagtcactttaatattgttatttggatgtcaacctctaggtgtttgagacaggagagtgatatgggggcactggaaacacacaggcacggggtgtcctcacacttgggtagcccacacgatgtgatttcagggtgctgggaggtccccccactccccaaattactaacaagtggatagtactttacagtttatatgatctcatttgattcttaacatgagcctgtgagtgaaaaattccttcccctcttctacagattaggacgttgagattcagggaggttcagagggattcagggaagtcaagtggcacctggagtcccgtggctaatttgaggccggtaggggattcgaacccaggatttgtgcttcttatgcctgggcttctgctccctggggcatggtcttccccctagctttcccattcactgctttagcctaggggtcctaccctttattaaactgccagtgcctcactgcttttctcccccaaagacaaaaaaaaagtgtttttgcttttgttttgtttttcatgggcagagacctggaatttcagcttgagaatttgtgccatatgataaataaatcaacagatggctttttccttaaaaaaaaaaaaaaaaaaaactaagatgtatttgcagtgaggcataatttgtaccaaaaagtgctcaccacactgtagtcatgggggcaggaggcagccgcgggtgaagggagaaatcttggagtccaggcagcccccttctgggctgaactggggagctgggggtgctgccagccctgccaggttctcctaggaggcggcagctcatatggctgtgggaggaggcagagggagcctcatatgcacccacatttccagggatctagaagacagaaggaggaaaaccaccatcatgttaaagcagacagttaggtaacacatcctgtaatacaagttattttttccacatctaaaggctaaaaatagttgttagaatttaaagataattggtaaatgagtttctatccttctagtttcacatcaaatggaatcatgctgccttcacatcactagtgcccgttatttgtgtttaatttccacaatgttgtctaattccactctttgggcttccccagggatccagcctccctcactcgcccatcgcagggagatgctttattcatctttgtgtcttctgtgccgggcatagcgcatggcacagaataagcactcagtaattgattcacgagtgaataaatggatgagtgggtgagttcaatattgactacaaaaaccctaaggccacactggtgagtggctgcgcctgtagtcccagctgctggggaatctgaggcaggaggatctcttgagcccaggagtttgaaactagcctgggcgatatagcgagaacctgtctcaaatgacaaaaacagggccaggtgcagtggctcacgcctggaatcccagcactttaggaggccaagatgggaggatcacttgaggccaggagtccgagaccagcctgggcaacatagggagaccctgtctctacaaaaaattttttaaaaattagctgggcatggcggtgtgcgcttgtagtcccagctactcaggaggctgaggcaggaggatcacttgagcccaggaaattgaggctgcagcgagccatgatggcaccactgcactgcagcctgggcgtcagaacgagacctgctctcaaaaaaacaaacaaacaacaaaaaaaaaggctttcttaaagagacttgagaacagaaaggggaacagatacataacttatatatttatttgttcatctttccaccttcctggagggtggaggggaacaggtctgtatttggagttttgaatgctaaaagtgggaatacatgtactgtttgccatgatctgttcaaaagttaagccaaatgccttagattctcctgaaaactggaatgccactgtaaactataagccccacttcaaagataaaagatcttgatgaacagggctgggtctgtggactgggcctctccccaccacacaaggaagggtggtgccagttgaaggaaaatcacttaaatccttgctgtctcctaataaggtgtggtcccaggtagggctgtcagaattagcaaattaaaacacagggcatctgtgaaaattagaatttcagataacaacaaataattggcataggctgcataatgtccctcaaagatatcaggtcctaatctccagaacctgtaaatgtgatcttatttggaaaaggggtctttgtagatgtggttaaattaaggattttgagatggggggattatcctgtattatctaggtaggtcctaaatgcagtcacactcatccttgtaagaggaaggaagagagagatggaaaacacagaagagaagacaatgtggtgatggaggcagagattggagtgaggtggccacaagccaaggactgctggcagctaccagcagccagaaaagtccaggaaccaattctctcttggagctccagagggagtgtggccctgctgacaccttagcttcaacctagtgatcctgattttggactttggccttcagaagtgtgagggaatgaatatctgttgttttaagccaccaagtttatggtcatttcctacagcagccacaggaatcaaaaacagtaagtatgtcccatgcaatgtttgtgacacacaccaaaaatattacttgttgttcacctgaaattcaaatttaactgggtctcctgtattttatttggccaacctagttcccaggcccaaagaaagaggcttttgaaatttgcaagaaagctggttggagctgtcagaaagtggactttgtaaacacagtaccaccgaaccaatttgaactgtactacctctagacaaaagagagggcagtcagacagttgttcgtgatttcttctttcaacagtcatttgagcacttactacaaaacagaagctatgtgtaagggtggaggcgttagctgttaatcaggacctccaggctaagtttctgtattagtccgttttcacgctgctgataaagacatacccgagactggggaatttacaaaagaaagaggtttaattggacttacagttccaagtggctggggaagcctcacaatcatggcagaaggcaaggaggagcaagccacatcttacatggatggcagcagacagacagggagagagagcttgtgcaggggaactcctctttttaaaaccatcagatctcgttagacttattcactatcaagagaacagcacagaaaagacctgcccccatgattcagttacttcccaccagatccctcccacaacatgtgggaattcaagatgagatttgttaccatatcagttaccaacccttccagataaatcacgtgaaatatcgccattaacagagtgagctcaggtggttcttcagtgcatttctgatacctgaaccttccctgggaatttcacagaccatcaggctctccaccctttgatagcaggatagcagggcccaggttctgcaggaggagatgttaccacaggcctgaaagggagggaggggcagatgctacaggaagatgctggctctggattcgctggaggagctttcaagggaagtagatacacactgtctccatcatttcatgtccatcacactctaaaatgctttggacaagaagcaaatgttaaagacaaatgtggcccattttcctgtacaaagagggctgctcccatgccaggctattggcactggtgggcatgaggcttctctgctgccctggccggggggttctctcactcaccattggctctctgacacctggagagaccaccacccttgggctttcatgatgctcacagaatccacactgttggagctttaaggagcctggatcaactggaacaggcagggagtactaggacagcccagcattgccccaaaatatccaggcctgataaaagagaaaaacaggtagctcacaggaaaaggataaaaaaaggaggagggatttaacatgaaaaggtgcttgatctccctcataataaaaagactgctgattccatccaggcaagtgacagaaaaaaaaaaattaatttaaaaagactgctgataaaaccacagcgagacactgctgctcagggatctgagggtgtgggcagccaggctgccacgcatcatgggtcggagaggaagaccacacccctggagcagagggcggctgatctgtcagatgccctttgacagcacctcagcttccaagaattaaccctttctatgtgagcagaggcatccatggggggacacactggtgaatcatctgttatgtagaagtctggaaaacatcaggatggaactggtgaaataagtgtggcctctgacggaatggagcggtccgtctgcactgctgcgggtgcccctcagatcctgtgggtcagtgagaaaagcagtgaggaacaaggcaggtactgtgtactgtcctctgcgtgcaaggaaggccagcgcatgcaacagagtccacacagacatagcctaactctggaaggaagaatgagaatgcagtttcagtggtggcctctggtggggagaaactgggtgaagggagatgtcatttccatttctctactattaattttgtattaccatgcttaaatgttactttttacctttttttttttttttgagacagggtctctctctgttgcccaggcaggagtgcagtggtacaatcatggttcactgcagcctgaacctcccaggctcaagcaatcctcccacctcagcctcctgagtagctgggactataggcacgcataccaccgtgcccagctattttttttaatcaagatggagtttttctatgttgcccaggctggtctcaagctcctggactcaagcaatcctcctgcctcagcctcccaaagggctgagattaaaacgtgagtcaccctgcccagccaattgctttttaaaaaagattaaatgcatgtatacgctcaggcatcagcacacttggaaaggatgaaaatatccggaagaagggttcttttaaaaggctcctcaagtgatgctggcaggcatgacgaatgtccctggtcacaaaagctctgatctggcctaaccctgtcatgttagagactggagtgcgtgtgtgtgcgcgcaaagtgtggggggatgggggtgagtgtgtgtggtgtgtaagcatgagtgtgtatgtgtgtggtgtgggggtgtgtgctgtgtgagcgtgtgtgagtctgtgtgtgtagtgtgtgtgtgaagtatgtggtgtgtatgtgtgacgtgaggtgtgtgtggtgtgtgagttgtgtatggtgtgtgcatgagcatgtgtgtgggcatgtgatgtgtgtgtggtgtgtaagcatgtgtgagtgtgtatgtttgagcatgtgtggtgtgttgtgatatgtgtgtggtgtgtgagcatgtgtgtgtgatgtgtctgtgtgtggtgtgtgtgagcatgtgtgttgtgtgtgtggtgcatgtgtgtggcgtgtgagcgtgtgtgtgcattgtgtctgtgagcatgtgtgagtgtgtgtgtgttcagcatatataaggcatgtaactgaacacagcactttagagggctctcctggagtcagagggggtgggtaggaggagaagggaggtgggctagtgtgctgaagtatctactccttgtcatagtctgtgacaacccagactagcccatgagccaccctgttccctgcatttccaatgagacctcggtggacatgttccctgaggtgaggctgactgatgtcatttgacgatcttgatgccaaatccttttatatcaaaaacaaccagaacactctcttttctcttagtgctttcacccagatgaccacatttcatcctcccagccactctgggccaggtggcactgctggtttgaaagggaggtctcccctggagtaacttccgtgggcggattcacaccctgcccacagtcctgtcccagtcagcccaccatggtggtctccggttcctccagaattcccgcttttcagctcatccccacattcccggagggactgagagcgcagccccagggccctgctctttgggggccgtctctacacccagagaagcagcaaggcattcctaggtttctctttcagatgcagaacttcagtgttcagagatgttcccactggtcctgagagggctcagttcagctttaatgactgcgctgttgcgtgtgctctgcagagggcgggtggcccagcgtggctgactgcagttttcctgacgtggagcccgagcctgccccgctgtttattaattaaggatcactctgcttgcagaaccctgaactccccagaactgtgaggtgggagaaccccgagaggccacctggccccacttcccacctgctgcccaaaccccctctctgccttcctgacagtcaccccaactcccagtgatccccatcaaccatctgacaaggggactgagagggaagagaaaggaggggcccaaagaggaaggtaaaactgtcgggaacagcccccaaatgtgtgacagccttcagtggagttgcccactttcccttttctcctccctgcaggacctcccttctccccagtcctccccaacttctgaggttacattgagaaaagtctgcagagaggtgccagcatcacaaggtgttaaggaccacgagtttggcattttaacagatgccagagccacttgagaaatgtggtaactaagcccagagaggtacagttaacctccccagagtcacacagcaggttcatggcaaagctggactagcacaggtgtccttcccctgcagatccccttctgtgccccacatcacctccctccagtgtctgggccacctggagatgggccctcagactcacccggccagaggtgccatctcatgggagaggtctggccaggaagcatcgatatttgagatcccaagaaatgaagacttggcctgtcagatgacagacttcggtcatgggaacacgtgatctgttttacacatgcgtcccctcagcagcagctttccagaacattcccactttcttctgtagtgagaagaactctttccctgcagcctcctgcccaactcctccttcagtgtctttgcttcagtgtctttgataaaccattctgctttgcagagtgcgagctctgccttgcagggttcgcatctgcctgtgctgagtaaccaacgctaaggtcgagtggtcggtcacctctcataagagctagggttgtctcatgctgatgactaggacttgccctcaaggagaaaaataaatcaaaacaaaagcaaaaacagcaaacatgcatctcttaaagaaggctctgagtccaggtaaatttccttccactgaagcagccaggctgaattcgaattatctttgcccctgcttaaaaactaatgcaaattttcctagagaatatccactaattcctggagggggcatgggcattcctgatgcccatgagaggaccatttgctcttccctcagtatgctaaataacagaagcgacatttgttgctggaaagtatcagtgaagttaataaggtttttcttgcccagggtgagggaacagttcccaatgacaaatgctgtatgggaaggggctgtagaactgccagcccctttggtccatccgtaaagtgaactctgtggatcctggaggattccagcgtctttttttttttttctttttttttaagacagagccttgctgtcacccaggctggagtgcagtggcacgatctcagttcactgcaacctccgcctcccgggttcaagcgattctcatgtctcggcctcccgagcagcaagactacaggtgcgcaccaccatgcccgactaatttttgtattattagtagagacgggggtttcactctgttggccaggctggtctcaaactcctgacctcaggtgatccacccgcctcagcctcccaaagtgctgggattacaggcatgagccaccatgcccagccagcatctttcatttttctgtctgctttggccctttcctctctcactgtcttccttttccatttccaaagtcagtccatctcactattagcacaaaaactgctagagcgcttgtcattggtcatctctccctgcacctggctggtctgttcttggccactgaagcgtttcccccagctgttgctttaatcattttattgttattatgccttacttaagaaatggatatgagatgcatttacctgtctcttcctgccactctgcagagccagtaagatgtggtggaaagggcccaggctttggaggagggctggctggggttggatcttggctgccccctactagctgtgtgaccttgggtaagtagctggacctctctgagcctggttcggaatcatagcacctctctttcagggctgctgtaaggaatagcagtggtgtgtataaagcagagcgcacagccagcaactggcccctagccacactgctgagcacctactgtgataagctgccattgtggtgtgtgaagcaaaggggaaacatgcctgctgtagtgagcttcctgtagggcaggttgtagaaccagaggtgggttccaaggttacaaagggactcttagtgtattagtctgttctcacattactataaagacctacctgagactggatcatttataaagaaaagaggtttaattggctcacattggctgggtgcggtggctcacgcctgtaatcccagcattttgggaggccaaggccggcggatcacttgaggtcaggaatttgagaccagcctggccaacatggtgaaaccctgtctcttctaaaataaaatacaaaaattagctggccatggtggtgtgcgcctggaatcccagctactcaggaggctgaggtggaagaattgcttgagcccgggaggtggaggttgcagtgagccaagatcgccccactgcactctagcctgggcagcagactgagactctgtctcaataaaaaaaaaaaaaaagaaaagaaaaagaattgcaagaaataaattattgtttatgagctatatggtctgtggtaccttgttgtgggactgggagtcttggcgtctccctgaccctgcctgttgctgcagcaccgctcagccctgcctgctccctacctgcctcccctcggcctctcctgcctccaccgggcccctggtgcctcctctagagacagtcctcctgggaccgattgtgttctcacttacacgaggcatccaggactacagataaccagaggaaggggcgccccccccgcctgccctcctccctggcatcctcacgctgcagaggtcagagcctcatcccagccccttacctgcccctactctgtggagaaccgtggtcagttcgccaggccggatccacgaacggccttgtggaagatggtgagctcacacccagagctggctccgatgaccctgtctcctttacatgtttctaccttcccctccctaccttcccccactgctgggcgcagagtggaggcagatgaggtttaaagctcagaagggcttaaacgggttggggcgcagtggctcatgcctgtaatcccggcactttgggaggccaaggcagaggatcacttgagcccaggagttcgagaccaacctgagcaacatagtgagaccgcgtctctacaaaaaataaaataaataaaattagctttgcagggtggcatgcacctgcagtccctgctactcagaaggctgaggtgggaggatcgcttgtgcccaggagtttgaggctgcagtgagctatgctggcaccacagcactccagcctgagtaacagaatgagatcctgtctcaaaacaaacaaacaaacaaacaaaagaaggcttaaagggggctccaggtgggcttggcagcacaaagctatgaagttctatcttagacacaagttctgttactgggcctttgcaggctggcctgggtacctggctgccatagacagggaaccttccagatgagctgcaggcgtggagcacaggagccagggtgctcttcctgggctctgtccacaggcagaacgtacacagtctttgtacacgtccggcggctctggtgcctatttttgtttgtgtttttcttttgtttggggggatggatttggtttcccccgagccctctgtcctcctgtcacctggctggtgctcggcaatgttgaccagctgcctggctggagttggcagtggctaaggctgtgacagctaacatgttcctgagtcctctcatttcttcaccataatgccctgttgagtttgcagatactgtctctgtttttatctcccggggaaactgaggctcagagtggctaggccaccttcccatggtccctcagctcatgagggccacacagggcattgcggtggccttctcctcagccttgaccctccggccccagcattgctgcctcaaggggtctcctctgctgagccgtgcaccttctgcctggcagctccaactctgtggctgtgttcagtggctcagcactgccccttgaccctccctggccttctgcggatgccagactggagcactctgacaaggtctggggtggttgtatgggtcctgtgacctctatacacctcccagtgcctgggaatcctgcagatacaccctccttagccgtccctaaccatagaggacatttctgaggtccccgagagagtggggcacccctgcaggatccaactgctgggcccaggaaggatagcagcagcatgaggggttccattagccacaaactcacggcatggaaccttcacccacctcgcccctcatctgctgtttagcacctggcacgccgtgtatacttactgattattacattttaatggcaaattatagtggcaaacgtatgcatctttgcacaattgttgtacagcatgatgaacaagtcattaatagtaaagaataaatgtgaaagtgagaaaaatctgactgccaaagtttttactccttccttccctccccagacttttaaatgaaagtttagggataatcccttagttgtcctgctagtaggacttgcaattaaaagaattgggccaagaacacttctacgcttctccttttaggtttgggtgtaaattcggggtatttctcactgatgaaagcctggtgcagggcagaccgtgggaagctttcatttccggaatggaccatcaacatcccttggagaagaattctcttctccagacccagacctggtgtcctggcacccattgggcaagtgggtcctagaagacaaacctggtcagagcctggaggctgcttagcattccccacgcacattagcagctcggagagctcaggaagccgcagcccctccttgcctcaccagcctggatcaggacagcatcccctggaagacacacagggcctggcctctgattacccagcctggagggaaagctcaatcgagcatcatgtcacccggtgcccccatgcagggtggcactggtgagacccccaagccaatgataccacctcacaggagtgcaggcccattgtggccagatcatcttgacttttcaagataaatcagaaatcgtatttccatgagatatccctatttgcaagtgatggtgactaaattagaagtttttgaatattgtaacatgttcgtaggctgtttgtctggtttaaactctatctggaggaattcaagctagacttcaggaataacttcttgaggcaaggattttgagaccttagggaaagaaggacgtcttgggggtattctgactgttgtcctcctggaagggaagaacagagaactagaagactgcccttagcgaagttcaaagcacctaagcccgggaccctcagcaagtgttcttgagtcacagattctccctgaggcgcctctttctggctccatagaatggctgattctgtaactcggtgagtttgctttttttttttcctccatcacccaggctggagtgcagtgaagctggagtgccgtggagcgatcactgcaacctctgtctcccaggttcaagcaattctccttcctcagcctcccaagtagctgggattacaagcatgcagcaccacacctggctaatttttgtgtttttaatagagacggcccgaagtgctaggattacaggcatgagccaccgcggccagccataactctgtgactcttgttacaaaggccttatattttgctctttgagggtggttttggtttgatgcctgttggttgccatcttttaactagggatgttttatcaaaatgcccagccaaagtgtccaaacaaattataccttaaagtttgaaaatgtctggcacttctaattcaatgcctgttgtgccaggcactgggctgctgaggaactgagtcccgtccctgcaggctagctagagaacacacacacacacacacacacacacacacacagagtggtcttacaagtcagttttatattctacctatatgcaataaaggtattattatgttgaggtgccttgatataaaaatttttcttaaaggagaggatgcctaaaacaggcattacctgaaacctcctctctccagcattggttgtcttctgtcatgactcagggttttcactgagaatgggatggaaatgtggtctaaagatagggccaatgttgggactggatcccctctgggaagtcagaccaggctagggcaggtccttgaagccatcaggaaaagcctctggagccagaaacaaaacaaaaaaaaaatggtgttaactaaactcagtctcaaatcctgaataggactcaagtcaagcaaaataattaaaggagttagcaaagggcaagtcagagagaccgagcaacaccaatgtcttccgggagccctgtggcgagtgacagagcctggactctggagtagaactcatcttgtgtcttcttctgccactcgttagctgggtgaccttgagccaagccccttaacctcttggaccctatgttcttatctctaagtaggggctggtaatatcttcccctttgaggaatgccctctaaggggtgttgtgaagattcggtaaggtggcaggggtaggactcctggccagaaacaggcacataataaatgctaagtctctccttctctccacctgctggatgctgtagatactaaggatttcgatgtgaatgagacaaaacccctgccttccaggagcctttgagaatcagagaactagacccatttccagaacaaggggatgcagggtctggataaagttttggggatcaatagagcagagggctcccagaggatcccatagggttgactcctaactcaagggcatgagacaacccccaggaagggcaccctggaaggggtccggctgtccctgatttacttgtgggcactgggggaatgcccggagccatccagccctcagggctctgtgtgattctgggttcctcccataaaagataatcagattctttcacgttaatgtctttctccacctcattgcacatcatgcagctattcattgactcagcaagtatcagctttgcatgcgaccttggcctacccactttagcttttagtaatagctcccttcttgaataatacaaccagtggggaaacagaacctaactcttacctctgggaggcttatttgctttgagaacatatgtcctgcagttttgttcatatggcagtgaagtttcgtgcacacactctagagccaggcagcctgggttcaaagcgcagctctgccaggtcctaactgcatgaatttgggcaagtcgctcaacctctccatgcctgagtttcctcatctgtaagattggagcaatggtaatacctgctttttagggttgagaagagaattaaatgaattaagatgggtaaagtgcttagagtggagctttgcaagtagtaagtgctatgtaagtgttcgatttaaaatgaaagacccttaaatacattctttgttcatttcacaagcccttcatttcacaaccttacatttcacaaccaagctctgtctcccctggaatccagccataactctgctcacaagtgtgagacaggccccagcagagctgcacgaagaggagagaaggcagccccccagactcccaaccccctgtccaagatggcaaaaccagaacacagcctctgtaccaccccagcaggtattcagaatctgcaatctccaaagcccacttcaattgtaaatgtagagccacgtgcgctttaagtcacctgtcactctggaggctcttttgctcagttcctcaccattagcagggatgacagggagtgcaggagtgcggtcgactcccagatattggagagcgctgggctagctgcccattctcccggcctccactcctctttgctgtccagccatcacttgctctttgaaggcaaacaaaacagaaaacagtgccaaaagtatgggaagaaagccagcttctcccctggggtgcctgtgatgccatgcccaccctccctgaccacgcagcccctgtggaccctcagggccccaagcccccatttccatcacatgcgtacacccatgtgtgtccatagccgcccatctcagtcaataaggctgctcctgcccacttggaatagtggtgacaaccaggagtggcttatgggaactatcccaatggcctgacagcatgtccgctgcaaaccgctgaggtaggacactgccctcatgtctagctgatcagcaagaggcgcagttgctttcttaggtaacattgctgctgtgtcctggccattgctggggggtggcacttaatctacaccagaattttccctcctgtatcttccaagctgcttggatcttggtgctgaattaggttggactttgtcttgtggggaagggaggactatagaccctcaacgtaagcaatggtcagactattctaagaaaactcgccgaattaaagcatgaggtaaatttagttctgacttctgtccaccccactgccactgtccccttttatcccatgatcccttgcttttcttttcctcctctctccctatctcttgtgtttgacgcatgataggaattcagaaatatatgtttgtggatttgtttattcacgtagcaaaccatttcttgagtgcctaccatgggccaggtagaatgggcggccccgggctgcagtggtttcttcagcccctctccagggtttacactgtgcaagacggtttgtgatgggtcctcccatcgaggaccacactcttctttctctgtgccccttggtcctcagtctctgaccccacttcaaaggcagcattcactcagggaagctcccatacaatgctagtcagagtaaaagtttggacaaattgccaggaagcagcttgtcagtatgcataaacagcctttaaaatattactactctttgacccagaatttcacttctaggaatctgtcctaaggaagtagtcacatgcaaaagatttatgtaccaagatgttcatcaaagtgttgttttataacaggaagtctcagaagctggataaatatccaacctctggaaatggttagatagaatagtatgtagccattagaaaattatgtctatggggtttaaaatgtcatgggaaaacacttctgacataaaagagcatgagaactgtatatttagcataatcttaactatgttttagaatgcacaggaaaaaaatgtacaaacatattcatagtgatgtctctggtggtaggattatgatcagtaagtacttctgtctcttcatattttcctgtatttgataatacatgcatatgttgtttttaaaataagaaaaattttaagtttaaaattggagctgaaaagtgtttttaggtcaggcgaggtggctcacacctgtaatagcaccactttgggaggctgaggcagtcagatcacttgagcccaggagttcgagaccagcctggccaacatggtgaaaccccatctctactaaaaataaaaaaattagccatgtgtggtggcacacatctgtaatcccagctacttgggaggctgaggcatgagaattgcttgaacccaggaggtggaggttgcagtgagccaagatcgtgccactgcactctagtctgggcaacagagtaagactctatgtcaaagaaaaaaaaaaaagaaaagcctttttaaacagtagcagacataactatataatccttactaagctgtcggtcaaatttttatttatatatttattttattcatttattatttttagacagggtctcactctgttgcccaggctggagtacagtggcgtgatcatggctctcttcaaacttgacctcccgggctcaagtgatcctcccatcttagcctcccaagtagatgggaccacaggtgcataccaccacacctggctaattttttttattttttatttttagagatggtgtttactatgttgcccaggctagtctcaaactcctgggctcaagctatcctcccacctcggcctcccgaagtgctggggttaccagcatgagccactgtacccagccctcaaatttttaaaaatctataagagacattattggacaattagagaaattcacatatggacttataatagtatcagagtgtgtggtgtgatggttctggagggaatggactttttctttggagacaggcttttctatgcccacccttttatcttgctaacttatcatcatccaggttccagcagaaacattacttcccccaggaaatttcttaagggtgcagtatcatgatgtctgcagcaaattctcaaatagctcaggaaaaaagtacgtgtgtggtatgagtgtgtgtatgtatgtgtgtatatatatacacatatatacacatatatatacatatatgtgtatatatatacatatatgtgtatatatatacacacacatacacatatatatacacacacacatacatacatgtatttttatataattatatatgcagagagtgcaaatgttgccaagttaaagattggtgagtctaggtgaagggaatatggtatttattgtattatttgtgcaacttttcttaagtttgaaaattttcaaaacaaaaaattggaggaagaaggcatgccagtctaccccaagccctccattggaatgctgaaaatctaaacaatgtgatttggcaatttcatttcttttctgttgtgggccagtagtccttagatgttggggaagggggtagtcgctgaggtgtggttgacttaggatggaagaagcagaagtcaagactcccagggtcaaagtggtttgctctgctgacccaagtgtgggaggcccagagtcagcgtttcaggtgtgctaattcagcatggttctattcacggccaaagtccaccctgggcacctctctggcagcaatcttgggtgactctactaaggccaggcctccatgaccctatgtctggatcccatatctccacctctcccactgtctcaggaacggtgcttagctttttcttttccctctcctgtcttctttgccagcatgtagaaagtttaaataattcccctctttacaacaaaacaaaacatacccccttcagtcaaccaccctagctctcttctccttttcccagccagatttttttaaaagcatcctaggccaggcgcggtgactcacgcctgtaattccagcactttgggaggccaaggtgggtggatcacaaggtcaggagatcgagaccatcctggctaacatggtgaaaccccatctctactaaaaatacaaaaaagtagccgggagtggtggcaggtgcctgtagtcccagctactcgggaggctgaggcaggagaatggcgtgaacctggtaggcggaggttgcagtgagccgagatggcgccactgcactccagcctgggtgacagagtgagactccgtctcaggaaaaaaaaaaaaaaaaaaaaaaaaagcatcctcagcactttggcaactccatctcctcccaacatgtccctgttactggaatccagccaggactcagccccgatctttctactctaaccagttgtctcagttaacaaggacaggtttatgctgcagtgacaaacaagatcccaaattcttgtggcttcacacatctggcaccacctcatcttccagccttaggagtcatcttttagttccttgaaaactctttacagttttctgttggggccttgtcatatactattcccctggaatgttctttcctatcccctccctttcaccttgctaacttgtgcccatccttcaggtctcagcagaaacatcacttccttggggaagttttctccaacacccacactacacaggtgtcccatctacactcctatgactttgtggtacttgtctcacttcattttccactgccttccccacaaggcacctgcacaagggcaaggaccgtaccactgtacctatgtcactcattgctgtggtcacctgcactctggctgcctaccttaactacacattagaatcacctgaggagcttttaaagccacaatgcaagactccaccctaggccaattggatccaaatccctggggtagggccagacatcagtggagttatatatacatatatatattttgtttgtttgtttgtttgttttttgagacagagttttgctctgtcacccaggctggagtgcagtggcgcgatcttggctcactgcaagctccgcctctcgggttcacaccattctcctgcctcagcctcctgagtggctggaactacaagtgctcgccaccacgcccagctaatttttttgtgtttttagtagagatggggtttcaccgtgttagccaggatggtctcgatctcctgacctcatgatctgcctgcctcatcagcctcccagagtgctgggattacaggcatgagccactgcacccggccatcagtggatatatttttaaagcactgcagagaattctgttgcatcagcttgagaaccactgatctgccttgtgcttcacatttaaaacttttttttaatgaataaataaaccccaaaaaattaatctccctaagcctccctagaagataggatggtaaggatattttcctaggtaaaaatatgttaatttcatatttcatgaaatttcatgtttcatttcaatcaagctctgtcatacaccttacatggggcaagcccagtgcctgggcagggtgtaattatactcattacacaggcaaggaaaagtcacattaggtgatggagcacaaataggcagttaatggtttcagggctagttaggatatgtttgtctttcaattgcaagtaatagaagcccaaagaaattggttatttatataatataattgattggttcccaaatttgaaaaattcaggaatagacccagcttaggtacagctggatccagtcactcaaacaatgtcacaaagaaccctttgacaggaatgtatcctgtgttgactctactttgctctgagtagtctttccccaggtgatgataaaaatggtcatcatcgccaggcttgtgtcctgtttagtaggaatatacaagaagagctcagtaaatgctggccccaccactaagcaaaaacaaaacttttgttgttgttattgttgttttaaataacagcttagacctttcttctttccttgttattctctttcatctgtaatccagttttctacttctgaagtatagaatgttctgatgatttattcttcattacccacaacttgcacatgtttatttaaaaatgccaggattgcctggccgttgtgtgctgttaacctttgtttgctgttagtggatccctgaagttcaggctcccaggggagcagataatgggtatccagttcctgcaatatccaccctctggcaagccaagttccttcctgggtaaggttttgcctacctgcattcctagggaagtttctgggcctgaccaccaagccagctctgagaaggggtgcataagccccaccatgctttggctctgtccctatagaatattttatgttgttactgaaaactaaaggaagatgggtgcggtggctcatgcctgtaatcccagcactttgggaggccaagacagattgatcactcgatgccaggagttcaagaccagcctggccaacatggtgaaaccttgtctctacaaaaacaaaacaaaacaaaaattagccgggtatggtggcatgcacctgtggtaccagctactcaagaggctgaggcacaagaatctcttgaacctgggaggtagaggttgcagtgagccgagatcgcactactgcattccagcctgggtgacagagcaagattctgtctccaaaaaaaaaaaaaaaaagaaaaggaaagctaaaggagagagactaaaatgatatcaggttcctggagaacaaacagacatgattttgcttcatggcaggacagccggaagaagtgggattatatcctcacattacaaataagaaaactgagactcagaatggttaagtcacttgtcccaggccacacagccagtaaattacagaaacagaatttgaacccaaatcttccagctccaaagcttgtgttcttttcactacctcctgcttaattttttaatttctaagattagacccttcatctatccatgacacctgcctgtcatcccctgaaaaaaggtgaacgccgttcagaaatttttctagcctgagctcactcccagttcacttatttttgctttgtcatggctgcccagtccccacttgtagaccaggaataggtcatggctgcggggactacacgctgtcgctgctgcaagggccggcctctgtttccggggctgagtgggggccagacctgccaggagcaccatcttctgtgggtcctgcctggatgtcacatcccggccccaagaagtcactgcaaaccttcgtattattgagcttcacatcctagaatttgctgtcactgtggctgctgcatgaagttgtcctgagagaaacgggcattgtcattaacagggaaattgatggtctgggggaaaagtcatcctcattctcttgcagatctatgggtgattgagactggctgatgttgaaggggtttctcagccatcgtgtgccatgttatggaacagtggtgtagccagccatttgacacccagcgctgacctttgtttaacaacctcacctatatatgacaaaatgattgtcagaaataatcgtgtaatgaaatgactgtaataatggccagaaaagaaacgcagatagtaaaatgtttctcttgttgaactctgtacatataattgcaccaggatttttttcaaataaaaagtaaatattatactacaaaaaagggaaaaagcacaagcatttattaaatagctttctatatctttctgagttttgatcctttgattgcagactgatgtaatattttatgtaaatcattgcttggttactaagtgaactttaagaaaagtgagacgtctgcagaagttgcccataatttagcagctactgtattgtaccattgatgtacggctttattttcttgattaattatttaaacaatataattcacaattttaaaataataaatttccacttaaaatggtatttaaactcagcaaaatatatcatctatgagtaaaatttgtatttaccaagcaaaaatattacagtttgtggttcacatgctgtctcactgttttaaattttaaatacaaaaactccaagtaggctgggtgtggtggctcacacctgtaatcccagtactttgggaggctgaggcaggcatatcgcttgagttcaggagttcaagatttgcctgggcaacatagtgagatcctgtctctactgaaaacaattagctgggtgtggtggcacatgcctgcggtcccagctactcaggaggctgagataggaggatcacttgaaccctgggggacagaggttgcagtgaggcaagattgcaccactgcactccagcctgggtgacagattgagaccctgtctcaaaaaaagaaaaaaaaaaaagaaacacaaaaactccaggtggtcgcacagaatgacaggactgaagtaacttagctccaatttctgtcttcataatcactgtcctaccattgtctgtgcttagaatctacttgcttaatgcaggaacatgtgttctcacagagatggaaaatgcaaatggcgccagaagcaagctggaaattctgaaccattaagaatttactctctgccaggcacggtggctcacgcctgtaatcccaggactttgggaggctgaggcaggcagatcatctgaggtcaggagttcaagaccagcctggccaacatggtgaaacttcatctctacaaaaatacaaaaattagccaggcatgatggtgggtgcctgtaatcccagctactcgggaggctgaggcaggagaatcgcttgcacctgagaggtggaggttgcagtgagccgagatctatctgcaccattgcacttcagcctgggagacagagtaagactccatctcaaaaaaaaaaaaaaaaaaaaagaacttactctcaaaataaatacgtgtggctgactccacatatggtagggccaactgtataactagaagttctccaaataacttctgtggagaaaaaaaagtttattaaaggttaacttttttaaagtgctaactagaaccttactaacactgagatcgcaccaattgtttataacttagacagggccgggtgcagtggctcatgcctataatcccaacactttgggaggccgaggcaggtggatcacttgatgtcaggagttcgagaccagcctaaccaacatgatgaaaccccatctctactaaaaatacaaaaattagccaggcacggtggtacacgcctgtaatcccagctactggggagggtgaggcaggagaatctcttgaacccaggaggcggagattgcagtgggccaagatcgcaccattgcactctagccccagcaacaagagtgaaactctgtttcaaacaaacaaacaaaaaaaaaaacctcttggaccaggaaaatattttttaagggaggagtattttatcactggcattgtttaggattgcaggcacatgatgctaatgaaaagcagactaactattagttggttttattactgtttttgaactctctctctcccttttttttttttttgagacagagtctctctctctgtcacccaggctggaatgcagtgactgcagtctcagctcactacatcctctgcctcctcagttcaagtgattctcgtgcctcagcctcccgagtagctgggattacagggcaccacaccaggctaagtttttgtatttttagtagaggcagggtttcaccatgttgcccaggctggtctcaaactcctggcctcaagcgatctgcccatcttgacctcccaaagtgttgggattacaggcgtgagccaccgtgcctagccctgtttttgaactctctagagacagtccagccccttattacttgtcctgaggcagctgctcccttcacctggccccccgcattgtgttccggacccttgtcctggtggtgctaaagaatatctctgtcgatcctttggggactggggaaactgaggcccagtgccacgcgatgccatttgttcagggaagattaggtcatctgctaggtccccagtcacttgaccttcttcccagacaggaagaagctgctctgggtctctcagtgctccacgtgtctttgcacattgaaatgttttctgattttttttttttttttttgctgttacatttacttttaaaaaataacaagcaataaaatgttacatttgagaaggttgaaatgagaattgatttgagttaaattctagcagatttttcttagaagaatgatatcatcatctccagctacctgcaattgatctactctgaattaagaaagagacttccatttgttgtttatattttgcactcttgatgtgtttctttaaattatggtcatgggccaggtgtaggagctcacacctgtaatcccagcaccttgggactctgaggagggaggatcactggaggccaggagttcaagacctcgtctgtacagtaaattttaaaaattagccaggcatggtagcattcacctgtagtcttagctacttgggaggctgagatgggaggattgcttgagccagaactttgaggctacagtgagttattttcacgccactgccctctagcctggctgacagagcaagacctgcctcaaaaaaataagtaaaaaataaattaaatttcaatcattagcagtcattaggatatttaaatacagtatgttgaatcaaagttacgcatgtgtgtatttttttttccagagagttgtttatcatgtgggttttaatttaactttaaaaaaatgttggctggacagttgcccaaatggtatcatcagccatttggttgagaacgtatgtcctgcgggctcctctgtcactggagttttgctagctgacagccactggctagttagagactgcagtcagcacagatgcaggcgtggacttgcgcacgtaaccatgtcaatgcaaagccatcacttcttaaaaattctgaaccctgctgtctgagatggtggtgcagcggatagaactctgctctaagaggcagtagctaattccatgtcttctttgcccttgactagctgagtgactttgcacatggggcttgcctctctgttgccttgtctgcaaagtggaatcatcttttccttgctagacagaaggtggaccctggacctatggcctttttgagtttcccccccgcttcttagaaggacctctgatcctactgagtttaatacccacgggttaataattgggaaaagcaaaggaagcgcttctgtttaggtaattatatgcatgtttttgtctttttctggctggaaagatatccaagccactgggaaggtccgtggctacccagggtagccctctctggggagggctgctatatccaagagcccctcatgagaatttgaaaatcgaccatggtagggcctgctgacttttgacagctaatggtgtgctgagaattgtccctccaaagatgcctttccattccctcgggagagtctgggcagcccctactgggggctgggatgctggctcttccctcagcctccaccccaactgctctcttccctcctcccctccccagccccctaatttctctcacaaggctttgttctgcagcaacctttcctaatgcagtcctggcctcttcgcagcttcattacataaccttccgtggactcctggtccaaggatcaccccagaaagccagtcagaggtaggcacgcagctggggtccatttacttaccttccccaccccctcggaactcagaggtggtgcaggaatttggactccaagaattaacagctccaccaccatcaccagagccaaaactcaggatgcatgtgcttcatctgctgcttatttccagctgagagccagtggtgccatggttccttagggagccggtcccctgatgccggctcctggccccaaatctctctgatccgggctcttccagaatgtcttgtctccaccatcgcctttgaccaatggtgtccctttgcctggtaatgtcccctttgcctgatgatggccctgtcactcctctctttagcacagaggaggctgtttcatcccttcaagcctgccctcccttcaagtcttagctcaagttcaccttctccgcagagccttctccaatcttcttgactacgtctcctctcagctccagcaacctctgtctctggcactgattccttacttagctaagagaatcacagacacttggggctcaggacaatctgctttctctcttcttacccatggccttggactgtgtgtacctctttgtctccactcccaaacccaacccccagagggcagagagcatgttgtctgtccctttgctcagcatgaagccatgcgtgtggtagatcggcagagttccataacttgtgttgaccgaggggtcactttgctctgaaattacccctgtgtccttcagtatttgcacagatagcttcctggccagaccgaatatatccaagggcatggcccacctctgctcctgtttccaggtccctggtgggggttagttcatgccttcctcataatctgcccactggcctggtcctcaaggtcttcccaactgctcagccagagttgagaaaatgggtcgctccatcctgtttgtgtcgttctctccttcctggcccactctcctgcccacaggtatccaggggctgcctgtagcattagaggacatacatgcacatgcgtgggcatgggacactcacgtagcctccaagcacagcatcaataatgcattctgtgctttatagcatggaaagctgctctaaactttattacacagtggacatgtctgaagcagctcccaaatccacccctgagtgtgttggaattggcaagcctatcacttgggagtctagtttttttgttcgttaataatagatgcttcctgtggccccagcttggcaattttgatttaaagtgatcttaactgaagagactaatggacgggtctgaatttgtgccttttaagcacaaagtattgctcttaattaactggattctatcctttgagcaggcagaggccttcccccaagggcgtcattaacgatccacatctggacatcttccaaagccttcttctgtttcaggccaaccgcaggtgtgttcctgaacacccaggaggctatgagagccacatatgcctcccaaatacacacagtgtgcatgcccagggacatagagcagtgtgcaaagtcccattccatctctctccacctgggagaggatggctcttctgtctgattcatggctcaaagtggtaaaggagctccccactccccgtcccacgcctactcagagtctgcaaatatgtatgcgatatgagagctcgtcagttagctgtcttcagtgtggcgcacatttgaggagtctgactcccctccagcacaggccaatgtgcactgctctcctatctttgtacccccactgttgcactgtgcagaggttggagccatagaagtaccagagctgtgaaaggagaggccccctctcacctctgccctggtctccatccccactttctctaggaagctagtaggtgctgacaggggagagaagggaggggaggggtccagaaacagtggctcatgcctgcaatcctagcactttgggaggctgaggcaggaggatcatttgaggtcaggagtttgagaccagcctgggcaatgtagcaagaccctatctctacaaaaagaaaaaatgtaattagctgggtgtggtggtgggcacctgtagtcctagctacttgggaggatgaggtgggaggattgcttgagcccaagagtttgaggttacagtaagctgtgattgcaccactgcactccagcctgggcaacagagctgagaccctatctcaaaaaaagaaaaaaaaaaagaaaggagagagagagaaagaaaagaaaagaaaaaaaaaaaagaagggaagggaaagcccagaagagtgtggggagaggaggcggccgtcattctggggccctcagtgtgcacaaccagataacacatgctctgtgggcttttgtaccattttgcttgagcataaagaaaggaaggctgcccctaaatagaaagcactctggaggcaaacaaatctgactccaatcctggccctgccactttcccagctgaggacttagacaagcaccctagcctcttggacattctcagagccatctgctgcaagtgggtgctgccatacccaccttactgggcaggcttgggggaccaagggtggtaaatggctcagtctttcatgatgcggccacacagcaggtgcgccatccaggtccatttctttccttcctttcccccaaatcaagttgtcattaaagtactagtccacattaatgaaatcaactgtattaattttctatttgctgctataataaatcatcagaaatttagtggcttaaaccaacacaaatgtattaccttacagttctggaggccagaagccctccataggtgtcactgggctgaaatcaaggttttggcaaggttgcggtcctttctggagggtccaggggagaatccattttcttcctttttccagcttctaaaggtttcatgcattccttggctcatgatcttctatagctatagtcagaaaaattttccatcaatcatcttcaaagccagcaatggcaggatgagtcctcacatcaccttgctctgacaccagttctctgcctccctcttccacatgtcaggaccctcatgattactttgggctcactctgataatctgggatgatctctctattttagagtcagctgactgggaaccttaattccatctacaaccccaattcctctttgccatgtacagtgacatattcacaggttctggggattaggacgagcctgtctctgaaaggctactttacatgaaaattcatttttttaattaagatttttttttcctcttgagacaaggtctcactctatggttcaggctggagtgcagtggtatgatcacagctcactgcagcctcgacgtctctgggctcaggtgatcctcccacctcagcttccctagtagctggaactacaggggtgagcccccatgcccagctaatttttttttttttttttttttgagacagagtctcactcagtcacccaggctggtgtgcagtggtgcaatctcagctcacagcaacctccgcctcctgggttcaagtgattcttgtgcctcagcctcccaaggagctgggactacaggtgtgcaccaccacgcccgactaatttttgtatttttagtaaagatggggtttcaccatgttggccaggctggtctcaaactcctgatctcaagtgatccaccaacctcagcctctcaaagtgctgggattacaggtgtaagccaacatgcccggccccagctaatttttaaatattttttttgtagagatggggttttaccattttgtctaggctggtcttgaactcctgggctcaagcaaacctcccaccttggtctcccaaagtgctgggattacagcatgagccactgcactcggccttaagagaagatttaataattaatactttacaacaagatctggaagaggtgggatgagtaactaaatgaggatacaagtaacccgggtcatatttgctaatacccttggtcacattgaacttgatatcttatcagattttcctaatcagctcctttagcagcagtgttgcagcatcttatctcattttgttttttgtttttttgcctagcacatgcctgtaaatcactggattgaggtgtttagatgtttgttgtcctttggatgcttcttataaatccatatttcatggctccctggaaagtgctatgcaaatgataagctgcaaggatggaaaggaaattgcagtgctcctgaattgtaaatgggcttttacgaggaggtttctaattactcgctctttctcttgaactgaggagttgaagtgtaggtggcagatccataacagataatcatgtgtgtgatgtgacttcagcctgagcgtcgaggaccaagtcacagagcaggaacagccactctccagtgtccttggggctacgtctgaggagaacctgggatttcatatatgacctgcactggctggggggctctcttgacgtaacgtgttccctctgagcatgttacagattctgacattcttatgttccttctgtggagagacatgtacttagtgacctaactcactttagcatatttttgctcatcgtttgtgtagcttaaaggaatcagataattaccccctccccactactttcggaagcacaaatgcaatgccctagaattgtactggggactcaaaaagaaaagagagtagtaaaatctattaaaggggacaaagacagcctatatactacaagctttctatttttatggcagagaatgccattttctaagtaaacagagaactgcatttgacctgcaatatcaaatgcatggatttgatgctttggaaagcaactgttttctgcgttaatctgggtgtcttccgtgaaatgtcctcctgcctttggcttaaacactagctttgtctacagccattccatcctgaacctgcccaatcttgtctgaatcctggtttcaccactgacaagctgtgtgtccttgggcaagttacttcacctgtctgtgcttcagagtcctcatctgtgagttggggaatctggacagaatctaccccatagggcgtagtgaggatgtgttgaattatcccaagtggctacacagagtaagcactcaaatgatgtcatcgttgtcatgattgctgttaccagagcctagagttcattctgatactcgagtctgtggcccatccagcccaggtaaggaatagttggaggagttgggcatgttcagcttgaagaggagacgacaggggatatgggatagttgaatctgtgaagggccccctgggatgaagaactggcatgttctgtgtggctccagggcactgagcaggacccatttgccaaagtctcagggacacagtttctagctatagacagaaaaattttctgtcactcagaggatgaaaatagaatgagcccccttaagaggtaatgagctccctgtcattggaaggattccagaagagctaggtaaccactttaggtgctatcaaggggcttttttctttaaagtcctttccaaaagcttctgagattgcataaacaataggaagccatcttggtgctttaacacaaactctccccagtgatgagggttgagccaaagccagattggcaagcagagaggagacttgtgtacaaggagttcctcgagtcaattgctttttccttgttctagccagccagagggctcctgttggaaaacaggagaccggagaggctgaggcctgaccaaaccagcttctgcaggccagctgggaggccacaactcctacctacgggaaaactgaagggcatctctatttttagattagcaaaagaaaataaatttaagtttgagtctcctttgcaacttttaaaagacatctttattgagatgatcattcacattctataaaattcccccactttgagttacaattcagtggttttagtcttccttgatgattttgatggtcttttcttaaggctcttggaagacccagaagcctctcagacacaggtgggtgtggagggcgtagcacagaggcagacttctcatttcctgggtctcccctttaatgactctcagagacccctccttccccctgcccctggcttctaccccaggggtgtagagttttgccattttccaagcagaacttcatttcctcttctgtgtctacactctttgtgcttctttcttgccagctttttctcctttgcccgcccttccttccttccttccctccctccccccttccctccttccctctttccctccttccccccttccacccttccccccttccccccttccctccttccttccttccttcctgcctgccttccttccttccttccttccttccttccttccttccttccttccttcctggtatgtgactaatttctgtttcaggacataaatgttgtccaggctgttctttggtctttctgttggataatggacatttggcattgagagaggctgctttttctgaaatcatgttcttggggcccagaacctaggtgtgtgcttctgactttgttttcttcctgatccaaattctgatatgtccatttaaattgatctagacccacagggcactgtgggacagatcctcagtggaacatgactctgtaacgagagcattttgttttgtcaaaatgagaacatattattgcctttcatctgattgtaaacataatacatgtttataaaacagtataatgagacaaaaatgtagacactaataagggaaaatctccctaattgtatttctcttcacagagaaagcccctgttgggcatatatactctagtttgtttatttgtttgactacacatatatgtattcttttcttatgtataaaaattctgaacatgcacatttctgcaactactgttttcacttgatgatgcatggacctctctagagtgtacgtttcttcttccttacaaagcagttggcttcgcccagggtgcaccaggacacggttttggctctgtccccagggtgtcacgggaccaggggatgatctcacagggtctgccatctgccctgcctggccggaggctgcatcgagagggccaaggggcaccacgtgtcgtgggtactgtcaaacaagagccttcagagccttccacagtctttcttttgcttcccagcattgcttccccgctggtggactctgaatctagaactagctccaggcgcctctccaaattcagacgggagctggggcactattataatgcaaatctaggcaaagccctcccaataccaggatccagaatggggtggggccctttgccctgaaaagctgtttagtttgaaaatacaaacaggagacagaaaagtttggctaaattaatggataaagttttaacgatggtaaccatagtagggttcatcgacagccagcgatggttctgaacacttgacatgtattaactcacctaatccccacattttacagacaatgcaaaggaggctctgggaggttgagtgacttgccccaaagtcgcacagctcctaagtgaaggattcggagtggactccaggcagcctggtctgactccctgcactgcgctgtgcttatctctggccccaatgccgccatgcagaagtgtctgggggcactttgtctctgtcagacagaattcggagatgtgtatgcttgccctggtatggcacttctctttttttgagacagaatctcactctgtcaccctggctggagtgcagtggcatgatctcagctcactgcaacctccgcctcccaggttcaagcaattcttgtgcctcagcctcccaagtagctgggattatagatgtgcaccatcgtgcctagctaaatttttgtacttttagtaaagatgttgttttgctgtgttggccaagctgatctcgaacttttggcctcaagtgatctgcctacctcagcctcccaaagtgctgggattacaggcatgagccaccatgcctggcagtgtggcacttcttacgtgtgttcagcggacactgtttatcttctgtccctccaagacggtgctgagctcaggtcgttcattactggcagacaactgctgatttccaacagaattgccatcctcttctcccctgcgactttcagagtgtgacctcagactcaaaaattagaagtgaaaacatcttaaaaactatcaccttttcttcctaatcctcctctcccctccctgtcttccttgttgtccccatctaatgaactatcatggcaaaaagagcccatttctggtcattttctgtggcctttcaaactcccacctaccccactgctcctgggtgcattacccgaaagctgagacttcagtgcagaaagtgccaggccctctgtccccccagatcgccttccttgtcttccctgtgcttgcctgtcacattgtgtgggttccagcgctggaaggaatgaggaacagattctctggttctccttttgaagtttaccttcgctccaccacttctgagaccttcccggaagttgccccttgtttctctcctctccagggctgccccagagctgcctctcacctcttcctgctgtcaccccaccaccatcagggcagaagttgggacaaagcctctcctactggctcctgcttttctcccttaggtccagcctcctcttctccatcttcaggagtctccttctccactcacacgtcatgacttcagcacctcgcatcagtccagaatatgactgcttgttcaagtgccacctttctcatgcatttttttctagtgacaatcacagccaccctgtggggcaggagtgtcatcatccccatgtttcaaatgaagaattgcagttcagagagggcaagtgactggcccagcctcaacagctagccagtggaccccaccagggcttctgactccagtccgggttccctttccacccaaatccatggagggagctgagccgagaacaggtgtccttcaggaagacgtgaagccaaagcctccacctccaaactcaggggcccagggagtccaggcacccatccactcacaaggctggatatggtgcattccaggagaggggttgggggcgagtggcctctctgtgtacccgtggggatagatgcgcaagtggcatcgccacatcgtgagtcctggcttcatgggtgagctccaggtccaacgagaagccaagcagggggcccttcaagctcagctttgggcccgggtcggggtacagggtagagcgggcctccccagcccctgccatgaggccaaggcagtgcatcgttcgcagcgtacattcagaaaccaaagcctaggagctggttatcattccggtttacagctgatggaagagcaggtgcttccgagaacccacagtgctctttggccagtgacccaagggtgcctctgagaggcctcgcagcacccggaggtgctgctgaggcaacgccctgactgtaagaaggaccattcatcctcagagagtggccgtgatgctgctgcgacagtcccaccatccctcccgactctcactcccaacagacttcccactgtaaagctgaactctccagcaaatcacctctcgccagactctctcctcactctctctgggtccactagaggttcctcagcctctctttgccttggttttcccagctgtaaaatggagcaaagagggcctatgtacccacaaaggtgtggttggagcgactcctcctacattagggcctcgagtggggcttcatgattggttggtggaggtctccaaacccacccagtgccaccgaaggctgagactgcagatgcaatgccacaggtgtccttcctcagcctgggcagctgaacatcatgtgtaaaacggggataataagataataacagccccttgcacctatgtggctgtgaggattaaacaagataaatgtgtaacagtgcctggctatagaaatatttactcttgttattaagggaagaatatgtgtggctaaaaagggatcgaagatgtaaaagccaatccctccccctctagcatatttaagggtaatgttgagttggtttgtggaccatttgctgcctgttagagctggaaggtagggaccccctctcaacagcgatgctacaaattatacccattggaggtcaaccaaaagacaaagcttattggctggacatggtggctcacacctgtaatcctagcactttgggaggccaaggcaggcggatcacttgagatcaggagttcgagaccagcctggccaacatggtgaaaccccatccctactaaaaatacaaaaattagctgggcgtggtggtgcacacctgtaatcccagctactcaggaggctgaggcaggagaatcactagaacccaggaggtgaaggttgcagtgagccgagatcgcaccactgtactcaaaccgaggcaacagagggagacgcaatctcaaaaaaaaagaaaaaaagacaaagcttgttaataccagcatattgttaagggaataaagtaggctgcagaacaactggtgtaatatggtgccatgtagggaaaattacatgtgtgcataggagaggggtctgcaaggttgtgccctaagatgttagagtggttcctttgcttttctcttttataattttgtatttgacttttaaataaggaccataaatcacttttataaaatacattctctccagcccctactactcctttaaagaataagagtggtttgcccaagaaagacagttttttttgctctggttttcttgattctgacatcagaggaaactgcttctcatccacttggggctctgggttcaggggattcatttcaggcagattaaagtggtgaccaggggcattcgtggacacagggagggacaggagcaccatcagtttgtctcacacaaccactgtcatcctcactgaaggctgttgcctgatcaaaaacagtattgggccaggcacggtggctcacacctgtaataccaccactttgggaggctgaggtgagtggatcacttgaggtcaggagttcgagatcaacctggccaacatggtgaaaccttgtctctactaaaagttcaaaaattagccaggcgtggtgggtgcctgtagtcccagctacttgggaggctgaggcaggagaattgcttgaacccgagaggtagaggttgcagtgagccgagatggcaccaccacactccagcctgggcgaccgagggggactctgtcttaaaaaaaaaaaaaaaaaatatatatatatatatatatatatgtcaaaaatggggtagtttttagatctatagtagttctaaaaacaaaggccatccaagcatgacagatttacaagcactattggctattccagtagttacaatggaggagagaagcttttagttaaaacaaacaaacaacacaacaaacccagaaaccttaggtcaaaaccaaaattgtcctctcagacacaatctgggaattttctcatgacagtgggcattagccaactgacatcagcagcaaccatccgtgtgcacacagtggcaccacctcctcccaaaaagcagccttcatctatgccctcatacaatcgttgattattctctttggattgaggcccggaattatttaagtttcttcttgccagcatgagtctttcctttctgtatgctccttatcttctctctttaatttggcagttctgcttgaaatctgggtctttcattagtagtagttcaatttggttccagaacattctgtggtgtgatgcaatgtgaccagagctcacacttcagagctcttcaagggccagtcttactgagcacctcccagtggctgcctgtgtgctgggcgccacttgtggtgggcaggagagaggaggggacacaaaaggagacacagctccttcttagaagctcaaagttggggaccagctgccacagaagagtatgtttagcatctgagacaccaagatccagcgtcacaagggtgtttattaagcctcctcatctctttctttttctttttttttttttttttcctcaggcagtcttactctgtcacccaggctggagtgcagtggcatgatctcggctcactgcatgcaaccaccacctcccgggtttaagcaattctcctgcctcagcctccccagtagctgggattacaggtgcccaccaccacacccagctaatttttgtgtttttagtagagacagggtttcaccatgttggtcaggctggtctcgaactcctgacctcagatgattcacccacctcggcctcccagtgtgctgggattacaggtgtgagccaccgcgcctggccttgctgttgattcatctatagtatgtttgacttgatgacctccagttaccttagacagaggttctcatctaagctccaactttccatttcctttgtcctcgtctttccccttaacccctccacatttctctcaaaatcaccccacttctaaaaaatactgtttatttttcttttaaatttcaaattatctatactcattgaaataaatcaaaatagcatggaataagcgaaaaaaatggatcccacccttccccactcccattccctagggctaaccatagttaaccatttaatgactaggtttttttgttgttgttattttttatttatttattttgagacagagtcttactctgtcacccaggctggagtgcagtggtgtgatctcggctcactgcaacctctgcctcccaggttcaagcattctcctgcctctgcctcctgagtagctgggattacaggtgcctgccaccacacctggctaatttttgtacttttggtagagacagggtttctcaatgttagccaggctggtctcgaactcctggcctcaagtgatctgcccaccttggccttccaaaatactgggattaaggtatgagccaccgcacccagccctcctgggctcttttcctttagttgcactcgctccccgctcctggagtagagggatttccgagagactgtgggctccagccttcacctaggcccaggactaggatgcctgccctaacatttatctttataccttaaagcaaaacagctggaccataagcattcaagaacaaactgtgaataaggagaaagttctcccaggaaacaagagctttagttctgttgggccagcccttatattccttagctgttaccagtcactgcttgatttaatctcggctatcacttggcctgacaggtctgctgctggtgccaggatgtctgggttttgaagcctggctccattacatacttcctgtgtgaccttgggcaacttactcaacctgtctgttcctcagtttccccagctgtattatgtcagcataatagtttgttgtgtgaattaaatgaggtaataactggaaatgcttcaaacatggttcctatcatgagaaatcctgctttccgcctaaatgtgctggaaaattcctggtggtgcagaacaggagaccagagcaaaggaaagacagggtgcagaagccaaaaattaccttggagaacaaagcgcatgttaaggttatttttggattctaggtttatctctgcttggtcttcagttacctgcaagagatccatttaggggatttttgtttgtttttaacgatagctttattgagatataattcatatgccataaaagtcactcttttaaaatgtttccggtatattcacaaggctgtgcagccttccctgtccttgattccagtctgagtttttaactgaagggataaggaggaccacgctttccccagaccagaaccgcgggccagggggcgattctgctgagtcaccgcgggcgcctggtgcgcggcggcggagcccgggaccttccttggctgccccctagcgagggccgcagcgcagcctgagacacccgccggggccgctccacggccgtcggatttagactggaagctcggtccaggtccccagcttgatgcgcccgcggtgtaggagaccagcccgactcgggcttcccctgagcccctggactcttgactccagcagggcctgggtaatgaacgtcagctcccctttcccaaaggggttgctctgttgggaaggcacccgtttgatacagtagcatagagatgggttttagcatcaaaatatcagaattcaagccttgctctctgcttactagctgtgtgaccctaaaaaggtttctgaacgtctctgagcttcagtttcctcatcattccttctcacggggtggttgtgagcattacagagatcctctctgtgaagcccctgtgagtggctcatcctgagggctgaaataaacatgttattaataatccaaaactggcaagggatgttgactggtccccctcccttgcccaaggagctttctagaacctgagttatcattaccaaactgtactgccttgagtaagaaagttagaaggaatgggaaggatggtggcaggtggaggaaggcggattggtcatcacctccttgcagcaagaaacagccccagatcgtgggaaacctacagacctgctagacagactaggagcaaaagctggggctttaagaatccccagggaggttctcctgagagagtagccagttggattttgtaagcagagatttgtttggggaggaggtgacaacgtagggagcagaggggcaaagctgtcgggaatcctgccttgagggcagggatgtgtgttggggggagttgggtcactggggctcggtggccttgggcaagtttctacctctcaggtcctttacccacctagggtcgccatcctgcccacctcacaggttacagtgagcctggatgcactgtcatgggcaggtgcccaggaaaatggcagacatgttccaaacagcacgcagcattccccagtgatgcccagggtcaccttggaggtgggcgagatgcctggggtttctcgtccaccccacaacacctcaggggacagccaaagctgtcccttcaggtaagctgcacagaagatgtgaactctgctgcaaagactctattctttgggagcaaaagggacccagggtctcacctgcacatccctgtccctgagggcctaggggttcttggaggccccagccttggcaaaatgaggaagaaggtgaaggttgtctgggcccctgccaggctccttcctcggccacgcactccccttcctgcacacacacccttctccctccaccccatctccattgttgtcagaaaagtcacaataaaaaggtccatattgtctagttcccatacttttaatttttaaaattttatttatttatttatttatgtattttttgagacagagtcttaacccaggctggagttcagtggcatgatctaggctcactgcaacctctccctcctgggttcaagtgattctcatgcctcagcctcccgagtagctgagattacagatatgtgccactatgcccagctaatttttgtatttttagtagagacggggtttcaccatgttggccaggctggtctcgaactcctggcctcaagtgatctgcctgcctgagcctccggaagtgctgggatttcaggtgtgagccaccgcactcggctccacacttttcacttattaaaagactgtggtgtccatcaatggatgaatgaataaaccaatgtggactatccctcccattacccaaggaatgaagcacggagccgtgccaagatctggattcacagtgaaagaagccagtcaccaaaagccacgtgctgtgtgacttcccttatacgaaatatccagaagagatacatccatggtgacagaaagtagatgagcagctggggactggcgaaggggagaagggggagcagctgtctatgaggtccagcctttcttctgggtttggtgagaatgttttggaactagatagaggtgatagttgtacaacattgtgaatgtactaaatgccactgaatcattcattttaaatcgttctttacgttgcatgaattttaagtcaatcaaaaacagttgtttgaaaagagaaaagcctatgggtagcggcagcagtgattggatttatgattcgattccatggctcatccctcccctgcctcaccccctcgccctccgacgtcttcttcttttactctgaactgttatctttgttctcatctctctctctctctctcaaccctgcagacacttttccctttctttgtctgcccccaccctccagatttccgtgtctccagtgtctccctacgaggcatgaattgagactgggagggtgtgattctgaagaaggcaccaacagtgactcagctagccccttcccccaccccgccccccgggcctcaatttagctaaaaaaccacagggacggactcaggaggcaatacctttccaagggtccctaaaaaatgtcccattttagtgtccaggtttcactcaactttagtgcctcccctaaaatgtgttccttacctcccaccccactgcatctaagtcactgcctgagaaaacaggattgaggaaaggagaaaggaagagagagagagaggaggagagagagagagagggaggaaggctgatggatttagaaaagaagaaaacaagtggtctgaggaaaacagccttggtgtgtttattttcctgtctgtgtatcgcttctcggccttttggctaagatcaagtgtattttcctgtctgtgtgtctcgcttagattacagggatctgtgggtgatgacacgtctggtccaggctgcgtagtcacctcaagggcatgcttattgatgtgtttttcaattcactatctttgcatgggagtcccaggccaagaggcacagctgcgccatttgtctgttggtttagatatcctttatccagttcttccagagaaatcatcctgcccttctggaggaggtgggcagcaggggtcagagatgggagggaaaggaaggagccaggtccttggctaggatgccagggtcccctgcctctcacctggcctgggctggaggcctcctgctgtcctgtcactgatcactaccccgccccagcctcctgagttagaagacacaggctaaagtagagtatttcttcattgaaaaacccatacaaaataaaggttcataaaaaataaaaatttagactgggtgctgtggctcacacctgtgatcccagcactttgggaggccaaggcaggtggatcgcttgagccctggggttcatgaccagcctgggcaacatagtgaaaccccatctctacaaaaaatacaaaaaattagccaggcatggtggtgcatacctgtggtcccagcttctcagcctatggacccacatagaatacaatgtcagcataagaagggagccctggggtcaccaaatggtttgggcggcaaagaacctgaaggttgagagaagtggcttggttacccagctgttggatgtgagacctggccactgcttcttccataccctagacctgcaccctgacatctcaagtaaaaagttgggggatgttttatggtccaggatgaaggaagggcagtgaggggcagcggagcatcactttgcatttctgtctgcctcttactggctgtgtgacctggggcaggtaacttcccagactcctgggaatcataacacctatgatgatgatgatgatgatgatgatgatgacacctacctcaaggattgccctgaagggtcacagagatgcctgcaaggcacctgcatggagcaagcgccccttctctggcaggtgctgggtgagcactacctgctgccaggccctggggctatggcactgcgtgaccctgcaagtcctacctggcgaagctgtcgttcttgtgctcagtcagtgttggttgtaagactgagaagagtcacttcattttgctctccagggacatctttctgggtcctattttctgcctatgtcaagtagcgcctcaaggatgctcctgaaaatgggcttgtctttcttaacatggcaggtaggtcccaaagcattagcatggggcagctgacctagcccagccaatgcagtgcagtgactcttgcaaccgagtctaatcagaaggtccatgaacctacgagcatttcctgtcccaggatcagggtggaggctgagcctccctgcttagagattcttcccatgcattccacttttttccccaaaagaaaatattgacccttgagaggcacacagtttatttattttgcatagtaaatagtagcctgtattttaaggatgagttgatttctgcatcagcccctgtaggtcatcagccttctattggtgcatctgactctctctagccctgcagggatggtggagggggaggggaaggagggatctttattggaaaccaggacagtgagactcattgccctgtcatctgctctgtggtgctgaatgaggcagcccaacagagaaataccctgagcgagcatccccagcctccaaaacagtggcgcattgccctgagtcctgggaatgacctttgattctcctgctcctgacttggaacccatggaaacctctagaagcagctgaggaaaacccaacatgaaaagcagaactccacactgagaatataggaggtgatcggaacatacaatgattcttgctaagaccgattcacagtttttcttttttttcgatcgaagaaatactggagaagcctaaagaaggagtctaaaaactctggcacgtgggccaaaactgtccttgagctaagaatgattttcacatttttaagtggttgaaaaatgaaataaaataagatgatgttttgtgacacatgaaagctatgggaaattcaaattctaatatctataaatagtgttttatcagaacacagtcatgctcatttatttatgctcgatggctgctttcccgctacaattacgttgagcagttacaacagagaccacgtggcccacaaagccttacaatatttactatctggccctttccagaaaaaaatgtgccgactcttgaccttaacctcagcaatttgggaggccgaggcaggcggatcgcttgagctctggagttcatgaccagcctgggcaacatagtaagactccatctctacaaaaaatacaaaacattagccaggcatggtggtgcacacctgtggtcctagccactcgggagactgaggtgggaggatcgcctgagcccaggaagtcgaggctgcagtgagctgtgatggcaccactgcacctcagcctgggcgacagagcaagaccttgtctccaaataaataaataatgcaaagtaaaataaataaaaccatataaaaaggaatcaatttaaaattataatgaaagctggccgggcatggtggctcacgcctgtaatcccagcactttgggaggctgaggtgggtggatcacgaggccaggagatcgagaccatcttggctaacacggtgaaaccccgtctctactaaaaatacaaaaaaaaaattagccgggcacagtggcgggcgcctgtagtcccagctactcgggaggctgaggcaggagaatgtcttgaacccgggaggtggagcttgcagtgagccgagatcgtgccacttgcagtccagcctgggcgaaagagcgagactccgtctcaaaaacaaaaacaaaaacaaaaacaaaaaaaaattataatgaaagccaaggggcatagtagaacaaattttctagagctcattaagtcaaatgagtcaccagttagtaaaacgcagtcacggggaagagagggcaggattctttgaagcagcggctctcctaaaaacaacccacccttgtccagctgccttccctcctgagggtgttccctttgactgtgtgacccccatcccctatttcccaaccgtccaagcccacctctagcataatacgagcttttaatccctctccctgaccccaacccgattttgaagcccagtctagtattttctcaaatacacttcttggctccattccttcctttccatcacctctgccttttcactgcatgcttggaccactgcagtcagctccctatgaacagttgctctctacccatccaatcggccccgcctgctgctgccaaattcaccgagggcacctctgtggtgctgcctgtggacaaagtccaagccagccacctcacccacctacaggtgagtggggagcagccagcgtgtccagtggtttaccccatcgccacagacttggtgatgtgtcgatgtgcagagaaggggtgttggcagccacaacacaagcaaccccgccccatgtgagatctaagatgggcgtgctgggagccacctctgagaatccaacagaaggcagaggggagaacggctcacacggcacaaacactccttccttttttttttttctttttcctttttgaaaggagtctcactctattgcccaggcaggagtgcagtggtgcaatctcagctcactgcaacctccgcctcctaggttcaagcgattctccagcctcagcttcccaagtagctgggattacaggtacactccaccatgcccggctaatttttgtgtttttagtagagacggggtttccctatgttggccaggctggtcttgagctcctgacctcaggtgatctgcctgccttggcctcccaaagtgctgggattacaggtgtgagccatggggcctagcctccttccatttaaatgtatgcctaatttgcccattgagaacggctgagacgcattttaagtggccagggtctacttagagttagtgctcatgaccaggcccaggtcaagcctggctggccagatggtgcctttgacctgctctgtctctgtgcaaaggaatgagctgaaggatgggggtgcagtgtgtgggcagtgggctggggctggcaggactcagtgactaagggaagagaactttcctcactaccagcctgtcttttcagggcaccgcggggggctttgggacttggtgatgaacacagcacagagagctgtccagcatgcgggtccctggcttctcacacttcccaggctccttcagaggctctctccaaagggagctgctctctctagaacccatgaatttggaatataggcaaccactgcattggggaccactgacctcaaacatagagaccagagcaaatggggctcatcacgtgaaactcatctggaactctagcaggttcttttatatatatatatatatatatatatatatatatatatatatatatatatatattttttattattatactttaagttctagggtacatgtgcacaacatgcaggtttgttacatatgtatacatgtgccatgttggtgtgctgcacccattaattcatcatttacattaggtatatctcctaatgctatccctccccactccccccaccccacaacaggccccagtgtgtgatgttccccttcctgtgtccaagtgttctcattgttcaattcccacctacgagtgagaacatgctgtgtttggtttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttataacagcatgatttatattcctttggttatatacccagtaatgagatggctgggtcaaatggtatttctagttctagatccctgaggaatcgccacactgtcttccacaatggttgaactagtttacagtcctaccaacagtgtaaaagtgttcctatttctccacatcctctccagcagctgttgtttcctgactttttaatgatcgccattctaactggtgtgagatgttatctcatggtggttttgatttgcatttctctgatggccagtgatgatgagcattttttcacgtgtctgttggcgaactctagcagcttcttttcacaagttcatggagagaggtttcccactgagggaatcacatctgtctgatcaaaagaggcttgggaaatggctctcctgttcattccctgaaaacctctgatggaaccactgccactgtggcagccccagcactggcaccccagccatgattggtgccccagccacatctctgctgtgagccccagagccctggttaattaatcatccacgtgttgatggggagaggcccattcacaaaagcgacataaagcccagggagacgtggccgtggcaagaagggtgtgggactacattccgcccccaactgagagattcagaaaccagaaaaaaatggaaaaacatactgtgctcttgggtgggaaaactaaatatcatgaagggagcaatttttatagttttggcctataatacaattccagccgaaatcccagtggaactttgagaatttgcaggaaaaaaaaaaatgtctaaagtacatctggaagacaaacttacaagaaggtcaaataattttgaaaaagaaaatgatatctaagcccacctagagaataagacttgagatccaaagctaaatcaggaggctctagcaaaattgacagataagcaggacagagtgcatggtgcattcacctggggaagagggcagattggtctacaaataggcctgggtccactgactttagctgttatatttggggagaaacttttcaacctcactccatcttaaacctaaaaatattccagatgaattaataaatataaaaaattagaccactaaaaatgtagaagaaaatggatgatctttctataccatagagcaatggaataaatcacaaaggaaaacagatttgactatataaaacttaaaccctgcccatcaaaaaccatcagaaaccaaaataaaaggcaaccaactggagaagatagttgccacaaatatgatcaagggttaatgttattcataaattaagagcccacacaagtcattagaataagcactgagacctgaacagacaagcaaaaagaatgagagtgggtcggcgcggcggctcatgcctgtaatcccagcactttggaaggctgaagcaggcggatcacttgatcccaggagttccaacaccagcctgagcaacatggtgaaaccctgcctctacaaaagtcataaatattagccgggtgtgatggcacacgcctgtagtcccagctactcaggaggctgaggtgggtggatcacttgagcccgggaggtagagtctgcagtgagccaagatcacaccgctgcactccagctggagcaacagagtgagaccctgacttaaaagaaaaaaaaaaaaaaagaggagaaaaatgctgatctcactagtaattaaaacatcaggccaggcgcagtggctcacacctttaatcccagcactctgggaggctgaggcaggcagatcacttgagatcaggagttctagaccagcttggccaacatggtgaaatcccgtctctacaaaaaatacaaaaattcgccaagcgtggtggcacatgcctgtgatcccagctactcgggaggctgagacaggagaattgcttgaacacgggaggcagaggttgcagtaagctgagatcgtaccattccagtccagcctgggctacagagcgagactctgtcccagaaaaaattaaaacatcacatatttaaacaactctaggatatcatttaaaaaaacattaatagactgttttttagagcacttttaggttcacagtgaaactgagtggaaggtacagagacttcccgtatgttccctgccctccacgtacagcctcccccactgccaacgtcctgcaccagagtggtacacttgttacaaccaatgaatcctcattaacatatcattatcacccaagttcatagtttacattagtaaaacatcatctttcatctataagcacaaaaattttttggcatttatttaggtgtatgattaactcagtgttgacaagactcacacttcatacccacttgcactgcatctgagaagcaattggtgtctacagccgctacaccctcaacaagcccgatcttgtttgaaaagcaattggtgatgcttctcaaaattctatggacaaagtcagccgggcatggtggctcatgcctgtaatccctaaactttgggaggccgaggcaggcagatcacctgaggtctggtgaaaccctgtctctactaaaaatgcaaaaattacccaggcatggtggctggggcctgtaatcccagctactcgggaggctgaggcaggagaatcgcttgaagcaaggaggcggaggtttcagtgagccaagattgcaccactgcactccagcctgggtgacaagagtgaaactccatctaaaaaaaaaaaattatggacaaagtttttcaaaaagatatttaatgcaactttatttgtaatattggaacatctgaggccatttcagtgctaactattaggggatggttaggaaaatatggtacatatgtggaaaggaacatttggtagttagtgcccctgatgtttacaaaggcttttagtgaccaacaaatgctcatgctataatcttatgtgaaaaaagcaagtagcataattgcaactatatttttaatgcatagaataaaaggctagaaggaaatatcacagatccttgacatacattcccaaacctttgtaaatccgcggattcatgaaaacagacacatttgcacaagtgcctgatcttttctgttatacattcattagaagtcaagccctggtgccacaaagtatctgccttttcaaatgtgatcagaatgttctcttttgcttcaaggccatttttcacgaagcagtggcatttttgcctcttcatcagagtcaccgtgtgccctggaggactgagaacagcagagccgttttaggatgggacagggcagccaggaggattgggctcactccctactgagtgcctcactcccgtacagcccccatagaggaagaggggttcaaatttattcctcagccagatggcatgtgccgcctgtcctggaatttcacatcacttatgatggaccaaaattccaaaagctgaatccatgattgtcaaagtctggtatggcaggatgtcaacagtaatcgtttctgggcagagggatgattttctcttcccatcttgctttgtataaatacattttctataataaggttgtattacttttctcatcaagaaatagcaaagtactgttttactcaaaatatgaatagagccaggcatggtggcagcttatgcctgtaatcccaacactttgagaggcggatatgggaggatcactttagcccaggagtttgagaccagcctgggcaacatagtgagacccccgtccccactcccccaaagaaaacccacaaagcatttatcctggattattcacaggggccaaaaaaaaaaaaaaaaattcaggcctcctatagccatgagctacgaatatgaaaatatgcaaatgtgtaagaaaagccagcacatccgatttttacttttactttcacacctctgtccaccatgttccaagagaagaaacttggtcattgaaaggaatagatcaaatccaaagaacaaaaccactgtgctcattaaacttcttagtgttcacaaagctttagctgcaggttgaatggggcaacccgaattggctggctcacctgggctgcagggagcagagatcgcgacactgcactccagcctgggcaacaaagcgagactctatctcaaaaaaaaaaaagttcataaattcaaagttatgaattatttttaaaataataataatttacaataaagatgaggacaaagtgtgagtaaatggtggtttctatccagctctgttgagctgaagtggcatctccctgctggggcttttggggaagaagggtgtgtgttgctcttcagatcccaagcctcatgcccctactgggccctgtggggtgcttctcagcccaccaggagagccaccgttggaacacacacgtgggggacctggtgggtgccggtgtggtgaatgggggccacagcctgactccaggaagccagcaaactcggagctggaggagtcaggacacccccgatgagtcaagagttggttttgctgccagttgacatctgattgaaccatctcttcacttctccgtgcctcactttccttaccagacaggctctgctgatgctgtccctctcctgttcagtcgtgccctcaccgttaaagagaaagagcaaactgctgggcagcagcattgatttttttaatgaagtggaaagagagctgggaataacaagtcgggcccacctcacctgcctcacctggtgggtttatttgttttgtttttttttttttgttttgagacagagtttcaccctgtcacccaggctggagtgcagtggtgtaatctcagctcactgcaacctccacctgccaggttcaattgattctcctgcctcagcctccccagtagctgggattacaggcacctgccacatgcctggctaattattgtatttttagtagagatggggttttaccatgttggccaggctggtctcgatcccctgacctcaggtgatccacccacctcggcctcccaaagtgctgagatcacaggcgtgagccaccatgcctggccgtcacctggtggtgttgaatatgaactgctgcggtgttggtaaattaagcaagcagatagatgtaaataacgcttgggcaggaatatggagcacgggatgaggatgggcggccaactgttagagagggtagcagggaggctgagatctgcctgccatgaactgggaggagaggctcctctctctcttcacccccactctgccccccaacactcctcagaacttatcctctcctcttctttccccaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaaggttagtggacagccatgcacagcaggcccagatcactgcaagccaaggggtggcgggaacagtttgcatccagaattgcaaagaaattttaaatacattattgtcttagactgtcagtaaagtaaagcctcattaatttgagtgggccaagataactcaagcagtgagataatggccagacacggtggctcacgcctgtaatcccagcactttggaaggcccaggcaggaggatcccttgaggccaggaatttgagaccggcctgggcaacatagcaagaccccgtctctaaaataatttaaaaattagccaggtgttgtggtgcatgtctatagtcctagctactcaggatgctgaggcagaaggatcacttgagcccaggagttcaaggttgcagtaagctgtgattataaaactgcactccagcctgagcaacagagcaagaccctgtcaaaaaaaaaagaaaagaaaaaagaaagaaagaaatttaccttgagttacccacatgagtgaatgtagggacagagattttagggccttaacaatctctcaaatacagggtactttttgaggcattagccacacctgttagcttataaatcagtggtattgattagcatgtaaaatatgtgactttaaacattgctttttatctcttacttagatcaggcctgagtggcctctctttagcaagagttggttagccctgggattcttactgtagccacattaataaacaacatcgacttctaaacattctataataccatcttttggccaaattgacttcgcctcttcctctctctttccaaatgaaatgtgtttcatttcactgtcagaccacatggttggggaccccacagagcacacagccctccctctgccttcccatgctggcccttcacccactgctggagtgccaggttggtccaagggttggaccaagttgtctgaggttgtctcaaggttggtcgaggctgtctccgcgctgggttgtgctacaaggagcccttctttccatgggtgtggctggcagtgagtgctcacagcaacagcccacagtgcagcccgagggcaggatggactcagtccctgcctccatacccatttctaaggaggcaaaatggcaaacactctacttttctcttttaatgctaaaaataagaaaacaccttgcagcccagggtatgggtagtgcatggaagccgtggagttgtgaggtgggaagtgacctctgctggatatgtctattcaggaagattgctggagtgggtggggtctctgggaggtcccctgagtgtgggaagctgggaccaccagctttctcgcacagggagtggccatcccagcttggagaggttccaggactggttgggaggcacgtttcagatttctatctgttgaatcagcgaagatattggattatgaggaatttgggaattaggaaagtgggtgcaggtgggttgggggtaggtgaaggaagacatgggcgtattgggggagcaggggctgctcagaggtgttccagaagctctgggtgaggaggtgagagggaccggggaatgcagctcggcccagcctccctgcctgaggtcagccatcacgtggtgatggcaagatggaaatgtgctttctgactgctccagccagtgctgccagattcagctccccagggagggcacctgagaggctccaagccaggagatctgttttctcctttgttttgtttttttttgttttgttttgttttattatactttaagttctagggtacatgtgcacaacgtgcaggtttgttacatatgtatacatgtgccatgttggtgtgctgcacccatcaacttgtcatttacattaggtatatctcctaatgctatccctcccccctccccccaccccctgttttctcctttgaatccttcttagaggccgggcgcggtggctcacgcctgtaatcccagcactttgggaggctgcggcaggaggattgcttgagcccaggagttccagaccagcctgggcaacatagtgagacctcgtctctacagataataattttaaaaattatccgggcatagtggcatgcacctatagtcccagctactcaagaggcagaggcaggaggatcacttgagcccaggaggcggaggttgccgtgagccaagatcccaccactgcactccagcctgggcgacagagacccccatgtcaaataataataataataaataaatccttctcagtcccttcctcactgtgtccccctccactgaatttttccacctcctctcccacttcccccactcccgctttccctctccttctctccccactccatctttttctttctctgctgtttctcgtccctccctcctctccatcccacaacactgcctaccctgtccctgccccaccctggtgctcaggatgtgtgaagtgaggggtggtagcccccaagacctcaaccccgaaggttagcctgttgaaaccactttctcccagctgcccccctggcagttggtgctgctgggggaaactgggattgggggccagattttgcctcttttcctgacaaagagagatgaagagttctctcaccaggtgcctgggactggggtgtgggtgtcccagcctatcccagcgcatctgttctgcatcatgattaatagtgctgctttcagccgggcgcggtggctcacacctgtaatcccagcactttgggaggctaaggtgggcagatcacaaggtcaggagttcgagaccagcctggccaacatggtgaaacctcgtctctactaaaaatacaaaaattaaccaggtgtggtggtgggtgcctgtagtcccagctacttgggaggctgaggcaggagaatcacttgaatctgggaagcagaggttgcagtgagccaagatcgtgccactgcactccagcctgggtgacagagtgagactccgtcctaaaaaaaaaggagttttgctctgtcgcccaggctggagtgtagtggcgccatctcggctcaccgcaacctgcgcctcccgggtgcaagcgattctcctgcctcagcctcccaagtagctaggattacaggcgcctaccaccacgcctggccagttcttgtatttttagaagagacggggtttcaccctgttggccaggctcgtctgggactcctgacctcaggtaatccgcccacctcagcctcccaaagtgctgggattgcaggcatgagccaccgtgcccagtcaactccttctcaaaaaaaaaaaaatagtgctgctttctctttcaagtgtcctgatttgggtgatagtaaatgccactctacttataagggatctacctcagaatgctaattgggacatttttgtagcactctactgttggcagcaggtgatgctcacaacagcccgtgagggtggatgacgtccgcttcacagatgacaaaggagcctcatgctcagaccgtgggctgccagagcaggtccatggctgcagccccacatggaccatatttcccccttgtcactctttccaccaagctcccttggaacttcagttattaagctctcttgggtggaatccaagttagaatcacaacatgtgcctcatatggattgtgccagtgaaaaatgacattctatttagaggcagggcagcctggcttagagtcagtttaaaatatgtattatgctgcaacaaatgtaccatgatcctgtaagatgttcacaacaagggaactggatgtggggtatactgtctgtactaacttcacaagttttctgtaaatctaaaactgttccaaaataacaagttcgtttaaaattaactccaggagaccaggtacggtagctaatgcctataatcccagcacttcggaaggctgaggcaggtggattgcttgagcccaggagtttgagacaagcctgggcaacatggtgaaatcctgtctctaaaaaaaatcacaaaaattagccaggtgtggtggcgcattcctgtagtcccagctacttgcggggctgaggtgggagaatcatctgagcccaggagtttgaggctgcagtgagctgtgattgtaccactgcactccaacctgggcaacagagcaagaccctgtctcaaaaaacaaaaatgaaataaagtccaggaaagaagtaggttttaccactcttattttctgaagagaaaactaaatttaatgtgtaaagtgaggacaagttcaccaagttagtgtttgagttgcctaaaatatgtttgctaaaactattcaaagctttcacataaaacatgatcagaagttctatgccaaaacatatgtgtgtgtatatatatatgcactatatatactgtatataaaaatgcaaaatctaaattgccaaccttttagaaattgctctgaaaggaaagcatttcaagataatttgcttacccaaagaatatactttccaagaaagcaagtaatacttaaggtgttcataatcctcatcaaattaattcttgctactgaaagcttacaaggagctgttttgatgtcgggtgtgacaggtttgacttggcagaaggtgtcactttactaacaacattttaaataagtgacagaagacaagaaactacacgttaaatgccagaacaaagagtgtctaagtggatgctaagagttgaaatatggctggatacctgcccaagagagctgaaaagtagatgaaagttggttacctataaactagtgcaccctaatgaattaaaaggtgttgatgagttaacttgttatgccttccagataagacatgcaaatggggcttcttcctccttcactacttccaagggatttaacaaggagaccaatgcaaatgataaggactgtagggctcaagctggggacagattggggaaagggggaccatcatgcccatatagatgtccctgtgccctggcagtcaaggctgctgaaaaataacaaaacccagaagtctgcgtgatgctgcctctccatttgtccaaagccttcttgcggcagtttgcaggcttttgcaaaagctccaggaccaaggagctatgttcatgctggaagcttgttcaggattagctgttctttgtgggatgggtgcagccagggccaggtgtccagggacagtgttttaacaaagggcatgaggtgtctgatctcacagtggaactccacttgcctttttttcatcttctcattctgcttcatgcacagaaccagccccatcctgaaactgactctaaattactcccgccccaggtggagtgcctttctcggagttcaacagagccttcctgtcgcccaagggacaactccactgaatgcccaagccacacccaaaacctaacaagtaaaaaccaaattctgtgctcccccatcctgggccattcctggtttctctactgctgttggtgataccaccatcagcttgtccatcatgaccctggccagttcctcccacaaccctccacagcacccagggacctcacctccattccatccgacacagatctcctcaccacaaaccttggttttgcaacagcagccatgagacctttacaccctccgcccttcatcctgtcccccactgaggccccagagccattccttaaagcagcgcgccacaaactataacccacaagccaattctggtacccagcctgttttgcacagccagtgaactgacaatgatcttttcatacagccagaaaaacaaaacaaaacaaaaaacaacaaaaaaaaaccccaccattctgagcatgtgacttccatgttcaagatgtctcatgttcagaaaggcccctggaaaaggaggaaggggagctgggcacaaagggagaccctctcagctgagctcctcccatccagacattttcctggacttcctatccaatgacttcccttagcttcttatcagccacccctgtctgcccaggaggctggaagatgtggccttttaactgggcacagctctgtcctctatcatatcagggctctgttcccaaggagggtagagagaatggacaccaggtggaccctcagcagtctgtgccacagagggagtgtttgcaatttccagactaaaagtccccatgtgcttgacggggtatgtgactacaacgtgatgcttgacttttcctcatatgaccagagccactttgtccatctggtacaatgtcagctatctgctaggggccctccaggattcccagtcaattccatatctgcatcaccaccattggcactaaataaaataaaatactcaagttcctgctggtgagcatgagcagtgctacactgggcccttcaaccaaggtgacatgataatgactgaaaataatcactgccacttattggggacgtctcatctgccaggcatggtacaaagtgctttaaataagcattcaacaatttcatgctgacagaagccctgtgagccagtggagctactactatgcccattatacaggggagaaaactgaggcagagagaggttaggtaattcgctcagcctcacacaaccaataggtggtggagccaggatttgggccccatctgcctgactctctagaggctctatcttccagtcttccagagttgagtctaagccatgaataggacaattagacagcagaggaaacccattcagccaccatgtgcatgaagagtaaggaatttctgtcatacagaggggagtgaattcactgagctgagagctgaggaaccattgatctgatggctgagacaccactgggaagactggagaggcttttctgggcatgcagtgccaggcacaggaggagctgagggaagatgactaagaggtactggcaaagaattcagaaattctgatggaagctttacatgttaccatcacatccatccatctatccacccatccatccacccatatcttcctccctccacccaatcatgcatacatccagtcatctatacaccacccacccacccatccatccatccatccatcccttcatccatcccatcatccatccaattatacatacatccaatcatatatctgtacataatccattcttccctcggttcatccatccatccattcatccatccatccacccatcccttccttcatccttcctatcatccatccaatcatatatctgtacataatccattcttccctcggttcatccatccatccattcatccatccatccacccatcccttccttcatccttcctatcatccatccaatcatacatatatccaatcatacatctgcacatcaccagctcatccatctatccatttatccatccatccttccttccatccatcattcatccatcatacatacatctaaccatacatctctacatcattcattcttccatcgattcatccaattatccatcattccttcctccatccatcccattatccatttgatcatacatatatcatctatacatcatccattcatccatccatccatccatccacccatatcttcatccaatcaatcatacatacatcgaatcatctacacatcacccatccatccatccatccattcatctatccacccatccatccatccatccatccattcatctatccacccatccatccatccatccatccatccatccatgtaaccatccagtcatatatccaattacacatccatccagttatacattcatacatgcatctaatcattcaattatacatacacacatccatataattctacatccaattatacctccatccaattacacattcatacacccacctaataaattattaattcatatatccatccatataattatacatcaattatacatccatctaatcattcagtaattcacccaccatccagtcatctatccaataatacattcatccaatcatccatccatccatccacccattcatccatccatccgtccgtccacccatcatggtatgagccatgatttaccacgatggtcccctgtggacagcccaggtggggcagaactgaagggaagcccagggctgcccccataaacatttgcctcctttacatggatgagaactagatccacatgtataaatcctcatgatttgaaggtgcttttaccaacattcactcatgggattctcccaggagctctaggaggaggcaggtagagttgaggtcatctcacgcattttacagatgaggaaacggaggccctgagaggcaggtccaaggccacctgaccagaaagaagtggaactgggacttgaacccagccatcttgccccttggtcccatgctctctagcctgtaactcctgcttcctggtggggcatctccaggaggaccctatcggctggccatgggcctgccctggagtcttttgctctgtgtggccatccttcctccctcaggagagtgtgtgctcccagagcacaggctgtatcttctgagcattttgtcccttcccagtacctagcactcagctctgtatacattgggctctcaagaattctcaaccttccagagtgtaaggccttgacctgctcagccctggatactgcatgatgcattgataagcccataaaataaccagggcagattgactcccagtggccaaagtgccacagggaagggacaattcagcccttctaggaggaggaggaggtagttttctcatttctattaaggcaacaaaagctgccttactaaggacattcttggtggagggcgtgactgtcaaccactgtgatcatttgggcctctcttgcccaggcttcccattctgaaaggacagttttattgtaggtacacatggctgccatttcaaatgtaactcacagcttgtccatcagtccttggaggtctttctatgaaaggagcttggtggcgtccaaacaccacccaatgtccacttagaagtaagcaccgtgtctgccctgagctgactccttttccaaggaaggggttggatcgctgagtgtttttccaggtgtctacttgttgttaattaatagcaatgacaaagcagaaggttcatgcgtagctcggctttctggtatttgctgcccgttgaccaatggaagataaacctttgcctcaggtggcaccactagctggttaagaggcactttgtcctttcacccaggagcaaacgcacatcacctgtgtcctcatctgatggccctggtgtggggcacagtcgtgttggcagggagggaggtggggttggtcccctttgtgggtttgttgcgaggccgtgttccagctgtttccacagggagcgattttcagctccacaggacactgctccccagttcctcctgagaacaaaagggggcgctggggagaggccaccgttctgagggctcactgtatgtgttccagaatctcccctgcagacccccactgaggacggatctgaggaaccgggctctgaaacctctgatgctaagagcactccaacagcggaaggtgggccccccttcagacgccccctccatgcctccagcctgtgcttagccgtgctttgagcctccctcctggctgcatctgctgctccccctggctgagagatgtgctcactccttcggtgctttgcaggacagcgtggtgggagctgagccttgcgtcgatgccttgcttgctggtgctgagtgtgggcaccttcatcccgtgtgtgctctggaggcagccacccttggacagtcccgcgcacagctccacaaagccccgctccatacgattgtcctcccacacccccttcaaaagccccctcctctctctttcttcaggggccagtaggtcccagagcagccatttggctgagggaaggggcaggtcagtggacatctgatcttggtttagtatccttcattttgggggctctgggtgtggcctgggcctctggactttggccacggtgtttgttccagcccttctcctaacctgtcctttccagacactcggcatctaggttattagcacctcgcatactttctgacatgctcctcagtcctgattttgaccatcttctcttgcttcccatctgtgtcagtcaagactgcatttggctgtaagaaacagaaaccccaactaactgtggcatttacatgaagaggtttacttttctcacataatcagatgtctagacttggccagcacctcaagggtcattgatgctctcctgtctttattttctgtcatctttagtggttggattgttgcctcatggttacaaagtggctgctgcacttccaggcatcacatctgcctttgaagcaggaacaagttgcaaagtaaagtggccaaaagggccctgaaactaaatgtgtccccttaggaaagcaggagttttcttgcaagtggcaatcttctgcttatgtctcattggccagagctgggtcttacggccaccccttgctgcgagcaaggctgggacattgagcattttgccgtccaacctctttagcagaataaaccaagggggaagaacgttaatagtggcttttgagtcactagttggcagtatctgcccctctatctttccatcctccccatggagtttcaaggttcctttctcagtacttcttcaggctctgcacgttcatttggatcttgtgtcttggggtgaaaaactggcccaagtgtctccccaagcatccacctttggattaatttggaaaatggctgtcaagtgcccgcctcttgcttggtataatgctacagctttagaggacgcagcaggcatgggccttgccgctgaggttcttagcctcatgagaatatccagatcagattctcttggctccttcttagagccagtgatgcaagacacttcctgctcatcttgtcgggacggttttacaagttgcctgccatcctgagaaagtctacaaaacgatgccagacctcatgccagcttcccaagccttgactctcagtgctccctcaacaggattctggaagaatctcccaaacaagtcgcaatgccctctggaccctgtgcaggcatgagactcaagagcattggctcccacccctggtggagggaacactgctggggctgggatcttgcctggttgctccgcctgcacccaagacaaccataattaaaatgtccttcattgaacttggaaagccttcaaagctgacaactccttatgtgtacccggaaaggcctgggagtgtgccagggcattgctcgggagggacgctgatttggaagcatttacctgatgagagactgacagcagctcctggtagccgagctttccctcctgcctctgctgtgaaggtggacccatccaacagtcaaatgcctgactctggacaggagcggacctatttattgccatgcaagggactctgcacttttgaattgtgggtcatgggcttggatttaggggttagagctgggagaagtcttggaagtcacctagagatgacactgccattttgcagatgaggaaaccgtccaatcaaaatggaccaaggacttgcccaaagcctcacagcaaaaccataggcccccgcactaaccccagagtccctgtgctgtcttaaggatcatatagttgtaagcaatcatctggttttcagtatttcttcttttaaaatgcctggggccatgcccagcagtctgtttcactgcagcgtttacacagggctgccgggctttcctggtggatgagctgggcggttcatgagccagaaccactcagcagcatgtcagtgtgcttcctggggagctggtagcaggggctccgggccctacttcagggctgctttctggcatatggctgatcccctcctcactcctcctccctgcattgctcctgcgcaagaagcaaaggtgaggggctgggtatggctcgtcctggcccctctaaggtggatctcggtggtttctagatgtgacagcacccttagtggatgagggagctcccggcaagcaggctgccgcgcagccccacacggagatcccagaaggaaccacaggtgagggtaagccccagagacccccaggcagtcaaggccctgctgggtgccccagctgacctgtgacagaagtgagggagctttgcgtgtttatcctcctgtggggcaggaacatgggtggattctggctcctgggaatcttgggttgtgagtagctcgatgccttggtgctcagttacctccctggctgcctgccagcctctcagagcatttagggccttctggacttctagatgctcctcatcttgcctcagtcagcgcgtcagttccagagacttctctgcagggttttctggggcaggtggtggcagacccgtgccttcttgacacctgaggtcagtccaccctcctgctcagactgcccagcacagggtcacctcccaaggggtggaccccaagatcacctgagcgcacagagggtgcagatgactggaccacaccttttggtgatcttaatgaggtggtcccagaggagctcagacatgcaatctagcatccagttctgggactctgtctccttttcaaacgtattcatgtagaacaggcatgacgagaatgccttgtcaacatgggtgatggggaatcaatcagacagggcgccgggctcaaggctgcagtcacccaagagtggctcagcccaccaggccctaggaaacgcctgcacagcctggagctcctggagtcatttccttcatgtcttcttcactgcacttacgtaaagatgccagccattggtttggtgatttggagggtgcccagttgcccaacaagaaatgcagaagaggcctagccaggatttcaccagcagtggagagtagagaagatgtggccagaaaagagtttcctttccctcctaaagatggtactccctgcagctactggggaagcctgcagcattctctagggctctgtgtgttgagagcagccccaccctggccccttctgagtgcatttctgctttgtgacttgatccgtgaagtcccctgagatgggcagaggggatgtcctcgaagctggggcagagcctcatccttgaacgtgaaggacgtttgaagactgtggcatgatcacaggatgagatcacagggaacttgagtttctctcctcctctcccttcacagttatttcactgagggaaatccctcccctgcccagaatgaaaactctagccaactcttgacttttccatcactccaaagtagttgaaagtacattagtctccacagtggcaaaacagtgtgcaaaagctaaataattagaacagccagtcccatgtgacagtcaaagcttctaactccattcaaagttgcagccattcccctcgagggctggcagggaggggaggggtaagagaaacaggaaggttcttactgagttggtcctggtgtgagctgcgtcacactccctgcagaggtttcaaggagactctctctctctctgtctccatggggaccttatttgaattcttctactcttaccccagcctgccatctccagctatcctcccctgaagagcccttctgctgcgctggattctggtggccatgtcatctcctcggccccgtgggagtctgaagatctggctgcagcctcacctctgaggtcctgctagttgccacctcttaaacatgatctgaggctcccatgcactctgacctgtgcccacatggggcccacgggaaacacgctggcaagcaaactgtgggtgtgcagacggttctcagggctgcagcacctgtcctttgctctgcccccaaagcaaggccagcccatcttccatcctctagtgttccttggtggggccctgaccacagtccaccaggtccctaaccagaggggacacacaccaggtgtcctcaatgtattgccttgaaacagttgtgctgggactgtgatggggggtggccatgtagccacccccaccacccccaagccactctctccaaggaaatcctcctaaagatccctttacatcctccatgtggtggggaggttctagagttgggtgcatgtgtcttcagctactgacaatgcagaccttagttggcacctcgctctggcctatcctgtttgctgttcttggcgctccagtgaaactccccatgggccatccagttggggtgcagtgtggccacccccttgcaggttcctgccttgctggagagcacagggccctcctggctcttgtaaaacactccccatggtacagagaggccagcagtgatgtgaggcccaacctccctccatggtgttcccaagcagctccctttctggggtcaaggggtggcaaagacagtgcagcgtccaatttctgactcaagccgggcctggctatcgcagctctgcactgtgtgtgacagcaaggcaactcacccagtgccgtggcagtgaccgtgtccgaggaagcctcctcacaccctctgtctcaaggactctggcatttagctggacttgctgtagctctgagcctttctgccattgccatcaccttgtcagaaactcaggccgaatctgcactcagagttgtgcccaggcagttgagccaacacttgctcagcgatattgtcacatgacaaggcactgtcaccactgggcatcgtgggtagcgcagtgtcggctggatggacccggagggtgtctgtgtcatgctagtgctagtgatgggagccccgtgagcccattgcccgccctcccatgccctcagcagctgcctggggacagccaatggcctgggtgtttctgaggctaccacatggcttccaggaaactcgagaacctttctctcccttgcctacactcttcacacaggcctgtgctggccagcggtggggatccggcattcctatcttaggtgcagagagtgactgactcattgcaggcctgggagataagactgatggcccagccagcaagatgtatggatttctcagaggcagtggcctctgtcattgtcctcaggaaatgctggtgattctggtggcctgaggtcaatgcatgtcaacgtggccaacttgccttataaactttttttctggacaattgcgtgcactgtcctgtaacagtgtcctgttgtttatgatgcagaaataggtgtttttaaagcctattgattttggtactattaatgtggtcaggaactttctcagtctttcttgtttggggtgagctgtggcttcctaaacaggaacccaagacacccccaaaagctgctcaccagcactgccagcctccctcttaccaagtagcacccgttcaggacattctgcgaaaggcatttgcccagaagttgggaggaaggaaatgtaacattttggggcacctaccatatgccaggcaccaggctaaacgtgttcacacaaattctcttactaaccctcaccatccttctacaagacaaactagtatcttcatcttggggttcaagatgaggaaatggaggctcagagaggttgaatgaatgccggtgcctggatatgaaccccatctgcctgactccgcaacccaggcaaagtctttccttgaacttcccagcagccactgcttagacacagcctccacaaccatggctcagcagcaaattgcttctctgacctcactcagcctgtgtgtccttgttgagtgaggcattcaggaccctggtcccaaagtggagaaagtctttcctactaggtcatagctacacctgcatgtgggtgctgtgccttttgtttagtgaacttttatcaccagcatcctcagcaatgacatttgcagagaagccagagctgaggcaccttggtattcttgggatgtgactttcctgaatgtttaagggaaaatgcccgaaggtacagagagcttggtttctagtaaacaataactgtcttgcttttaccccccttcatttgctgacacatacaccagctgaagaagcaggcattggagacacccccagcctggaagacgaagctgctggtcacgtgacccaaggtcagtgaactggaattgcctgccatgacttgggggttggggggagggacatggggtgggctctgccctgaaaagatcatttggacctgagctctaattcacaagtccaggagattttagggagttggttcttatcaaaggttggctactcagatatagaaagagccctagtggtttttttctaataccatttctgggtaattcctaaggcatttagtgttctgaaagatgctagccttgtccagcctgggagttgagaatgaatgtctaacagaaactctaggccgggcctggtggctcacgcctctaatcccagcactatgggagacccaggtgggcagatcacctgaggtcaggagtttgagaccagcctggccaacatgtgaaatcctgtctcactacaaataaaaaaattagccgggtgtggtggtaggtgcctataatcccagctactcaggaggctgaggcaggacaatcgctcgaacccaggaggtggacgttgcagtgagccgagatcgcatcattgcactccagcctgggcaacaaaagcaaaactccgtctcaaaaaaaaaaaagaaactcaaatatgtgtgacaggcgattctcactgcaggctgccctgtggctgatccaggagcaaggccttaaccatgtcatccccaagcgattgcttgtaaactttcttctgtgcagccttcaacccttattatgattttcttctcaggaaccaaactgctgtattcaagaaaggcagctttgtgtaatcatttatcataaatatcttaagaaaaatcctagagattcctaattttaggaaatgggagacctatggtactgatataatgtgggctgggcttgttttctgtcatttgctagataaatgaacttgagagcctactgtaaaatgtggaagcttctagattgcagaagggctggaaagacactgttcttttctcccgagtgatgggatctgtccagtatttagagctgcctctgaggccatctgattctaggagactctgcctcgttgaggatattttgaggcctaactacacattcctgcccccagagaggtcacagcctatagcaggctgatgtttctcatgtcacatggcacagaaaggcacattttcgttctcaggctaacaaagagcttcaaaaactattagaagggacagtggctataagagaagaacctcagtcaatgtgtgaaattaactaggaacctggctcctgtttcttttaggtcatgtttttcagcttaggtaaaactagaggctttgataaagcatgacctctagaaatcattgcttttcataaatggaagtgggtttgagttttttctactgattgttagtgcaggtgatgtctacatgcccccagaacatattccatgcaacaaaaaaagcccaggtcaccgtctttgctgggaacttgacttttgtgctcactgaattttaagctttctgacagcagcctggaatcatggagggataaagtacctattagtaagatggaaaaaggtgtttcaggttggagctgcagtctgttgagagtaagctatgggaaggcctgtatacgaggggtggacttttcttctgtaagtgtccagagaccaggcctcctgaagagggcatgggggcttaacttacctggactactgtgtttacaatactcatttatcttgaactcctcctaacccctgagaattgctacatttagtatttgctgagtacttcctagcatcctagggaatcaatagaacattctcccaaccaggctgggtgcggtggctcatgtctgtaatcccagcactttgggaggccaaggtaggcagatcccttgaggccaggagtgcaagactagcctggctgacatggtgaaaccccgtctttactaaaaatacaaaagttagccaggcatggtggtacacacctgtaatcccagctacatgggaggagtaggaggcaggagaattgcttgaacctgggaggtggaggttgctgtgagccgagatcatgccactgcactccagcctgggcgacagagtgagtgagactctgtttaaaaaaaaaaaaaaaaagaacattctcctaacctggcttcttcctccaggggtgtaattaatcatgtcagtttcctcattgatacacacacacacacactacaatcctgtatccattacttttcaaggtacatttactatttacgtttggggtccttgtctcttttttaatagtgtttcttaaagtcttgtattatatcagagtacagtaacatcccagtcaagagcactctagtaagctctaggaggaaagcgacttccggaaggcagtggagacctgtcctgttggggcagcataggggcagcccctgcctctggtcagttctggcgctcaggctcagggttgcctctgggctgttcttcccagagactgacaaagggctcccataaggcacctgcagagcctgtgagaagctgaagtcaatgttttcctgacaccagttgatctgtgcaggatccattgatttaaccacctgctgtgtggcatgcactgtggtcgatgccaggaacaggaattggaggggcccatgagcatggccagtatcacaggctggaggtgctgctgcgctctgaccgggcctcttggggatgagcccatgtcaaccaccttgcctccgatggggtcgggcccacaggttacctttgtgtgtccatgaccacaccttcctccccgacctcatccaaatctctttcttttccaagcccctgaatccttcagggctgcaggttttgtttaaagcagagctggtgagttgcataggttgttgcattgggactagatggggtgttcaaagagttgggagttaaaaaacataaagggtatttattaggagaaccaaggagtgtaattctcctgttcttaatatgcggccaggttaatgaatgtcacgtgaatgaaccagaaaaaaatgaagtgtgcccttgatcagctgggttggtgtgcagcaagctgtgtgaccaggggacagcagtggtcctgagggccgtcactgtctgccgtgcagagcccttcctcccacgggggcctacctcacctgtgccaagggcttgtctgtggtcagtgacctggatagatctgaatggggcttctttttcgaggagtcttatggcaggtctctcagtaaagactccattcttgatgatcacacattttggattttccaaatctgtcagagaatgggcttgaggcggggtttgtgggcactagtttcactggtttcatttaccaaaaaggggagcagaagtcaagtatggtggctcatccctgtaatcccagaggcaagagaattgcttgagcccaggagttcgagaccagcctgagcaacataaggagaccccgtctccacaaaaatgaaaaataacattttagtcagacgtggtggcatgcatctgtggtcccagctgcttgggagggtgagatgggagggttgtttgagccctggagttaaagttgcaatgagctgtgattgcaccactgcactctagcctgggtgacagaacgagaccctgtctcaaaaaaaaaaaaaaagaaagaaagaaaggaaaaaaaaaactcatgcctgtaatcccagcactttggggaccggggtgggcagatcacgaggtcaggagatcaagactatcctggccaacatggtgaaaccccgtttctactaaaaatacaaaaattagccaggtgtggtggcacgtgcctgtaatcccagttactcgggaggctgaggcaggagaatcgcttgaaccagggagtcagaggttgcagtgagctgagatcgtgccactgtactccagcctgggcgacagagtgagactctgtctcaaaccaaaaaaaaggggtggggggcgggggcaggagaacagtgagaggtagggagaggaaaggggattctcgctacacccaaaccagataccatctagaggctagaatctttgggaggctcaaattccctagaaagcaggagaagcttctgtagccctcccgctttcccagtagattaagcccagggcggctccagatgtgtgacatgctctgtgcccaaccagagcccatcataggcagaggaataacacccacaccagaagggccctcggaggtcaccacgtccaagaaccctctttacagatgaggaaactgaggcccagagaggggagagccacctagcgagctggtggcggctagaccaggagagctgtcattccaagcaagcaaaggcaacgagacgagcccagagctgtgctcccatctctttgttagggggcctgggatgccctctcagtgtcattttgtccaggatgatgctccctctcttaagcgattaatgcgcccttgctaaccttttgctatcgctgcctcttcaaaccagaggagttgagagttccgggccggcagaggaaggcgcctgaaaggcccctggccaatgagattagcgcccacgtccagcctggaccctgcggagaggcctctggggtctctgggccgtgcctcggggagaaagagccagaagctcccgtcccgctgaccgcgagccttcctcagcaccgtcccgtttgcccagcgcctcctccaacaggaggccctcaggagccctccctggagtggggacaaaaaggcggggactgggccgagaagggtccggcctttccgaagcccgccaccactgcgtatctccacacagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaaggtctgtgtcttgagcttcttcgctccttccctggggacctcccaggcctcccaggctgcgggcactgccactgagcttccaggcctcccgactcctgctgcttctgacgttcctaggacgccactaaatcgacacctgggtgcagctgctccactccctcggcctcctcccgtgctcaggctgtggccgcacgcgcccctcacgcttgcccgccactctgcatgtcaccagcacccccgctccgtgctacccaccttgtttgactctctggccacttgatttgtccacaacggcccatcagcccacaggaggtttggtgggtgccttccaccgacaggatgacgggtgccctcatggtgtctagaactctccaaccctcccatgtaggcataagcagccccactttgcagatgaggaaacggaggctcagagaagtacagtaacttgccgaaggccaatgagtagtaagtgacagagccaggtttgggatccaggtaggttgtctctgaaagacacgcctgtcctgcatcccacaacgcctcccaggaggtgctggagtgtggacgcctaacacagagatgtgcagggcacacacagcaggtgacacacacagcatccagaggtggcccagagctcatgctgtgcctttggcccagtgccctgcccccacccactctgccttgtggcaggaagacaaggagcagacacaagatctccctggtccacatgccaccacctccctctgcagaggacaaggggatcctcatgctggcattggagggggttgagcagggcccaccttgagccctcaggagcacgaccacagcagccctgcagggagggattggtgggaggagagtcccaagtatcagggagaggagagttggtgtcccacaggagacctcagagccacaaggcgagcttgttcataaatttgggacccttagcatttcacagttatttgcagagcccagaaatggatgttactgaagctcacagttgcaagcatctgttaaatttttattagattttacttttagggaaaactttgaaatgctataaagaagcctgtgtttaaaagttaagacagaggctgggggcgatggctcacgcctgtaatctcagcactttgggaggccaaggcaggtggatcatttgaggttaggagttcgagaccagcctggccaacatggtgagaccctgtctctactaaaattacaaaaaattagctgggcgtggtggcgggcacctgtagtcccagctactggggaggctgaagcaggataagtgcttgaacccaggaggcagaggttacagtgagccaagatcacaccactgtaccctaagcctgggcgacagagtgagactctgtctcaaaaaataaaataaaataaagttaagagagaaaaaaatatatcctatatcctttgttaaattccaaaacagtaggggacaaataactgacttgacaggttactacaatatttcctgaaatgatgttttcttgaatactggcctactagaggttcataggtgtgtttggattaaaaaagagttccatggcccagtgactgggggaaaaaaataaaagactaaagtaagttaaacaggcttttctgctgcaggacttgtcagagcctttaatgtactaatggccattgtgaccctctgagaaggtcacagagtgggtttcccaaacttacttgattctacctgctaacatttcctggaggaagtttgggaaatgccgatttagcagattcttttgttgtgccgtggatggtgctggttgatgtgggcaaaacaaagaacacgtgagtcagatccgcctggggctcttactaaagtgcaggttcccaggtgccactttaggcttacagacccagttgtggggtaagcctgggagtcttttagcaggtgattctgccacatagtatagttggaaaacctctgggcatactcattgctggtccctctagaaatccaggtgacaatagccaatgagaagctccaagagacccagttgtccatggggtagagggaatgtgatattgaaaccaaagaagaaaatctatgatcagttttcagcagtgactgtcaagagaaggagaagggtgagttagcgctgatgctggctgacaggtcagcgggttggtttcaccaaggagtgtgatgaaggctgatgttgtctgtgggaatgtatgatggtaactggtttgtagctaatttggggaagcagtgagaattcgtgccctttgaagaccagtaagtggcaagaaacccaccaggcctggctcagggctgggctgggcttggctcgtctcagagcagctggggctggtggccaaagccaccattagtgaggggcaggccctgggggtacaaccagcaactaggggacaaagacaaccctgccagcctctcctattctggaggcgtgtgaccagaaatggagatgggttggtcagcataagatggccaggaaggtggaaatcaggactgctggcaatctagccacatgggcaggggagccgggtggttccaggcagtttccaaggccaagagggtgagcaggcacctcacagggaatcagggccaagcctggctgcagtgtggagacaatgcacccacccccatccttggatcttgcaggaggctgggtcctcactgagctaccaacatccatggccctgaggcttttaaaacacccatccatggagtggggctggtcccagtggggtgaggctgaccctggcagaaacagggcaggagcctgtgggttagggagactgcaccttccttagatagcctccatgccatcatgtccccgtgacagtttctgctgcgtcccctctgcatggtcccaccctcggccagcctgctgccccctcttgccaggttgcgctaatcagtgaccccagtgtgctgtgttgatactaacaatgcgaggcctagcagattcaagggaaaagagaaccaactgggtttccaccagacccaactaaacaaacatggacctatcccagagaaatccagcttcaccacagctggctttctgtgaacagtgaaaatggagtgtgacaagcattcttattttatattttatcagctcgcatggtcagtaaaagcaaagacgggactggaagcgatgacaaaaaagccaaggtaagctgacgatgccacggagctctgcagctggtcaagtttacagagaagctgtgctttatgtctgattcattctcatatataatgtggggagtatttgtcactaaagtacagctgtcatttaaagtgctttgtattttggggcaggcttttaaaaagtccagcatttattagttttgatacttaccccagggaagagcagttggcaggttcatgaagtcatgctcctaattccagctttcttagtgtactttcagtgagaccctgacagtaaatgaaggtgtgtttgaaaaccaaacccaggacagtaaatgaaggtgtgtttgaaaaccagccctaggacagtaaatgaagccatcttctcactgcataaactgcacccagatcttcgcccatccttctcagtatttcacttcacccattgtttactgtctcaatgactggggaaatgtctggggaaatgctcccgtaattgcacagtggcgtttttcctggaaaatcccaccatggctctagataagacctatttttcttaaaggtatctaaaatttccagcataaattctgtctgaaacacctgaattttaatcagtactggagcccggagggcatctccagttgccacatagctctgagcattcagtggtgtgttgagggctgctcccggaagtgcctgcagagtcagggctccccagcctcatctagtgaggcagtggaagggcctgtggggatttggagagctggcctgggtctctgaagtgatagtgacagctgcttgtcaatcacggtgcacatttagtgctgggggcagggggcagggaataccagcctcatgcatgcatgcattcatttgttccttccttcattcattcattcagtacacatgggtacaacatccctgccctggagttgcccagagtctagggaggggaaagatctattaccctgggcctcggccagctggggagtgctgctggtggagaggggccgtgtgcagcgagggaaggaggagtcgtcaatacccccaccccagctttgctttcttgtcatcagccccagggccccagcctgtgtccctcctctcccattgctacttcatctcctgggtcctccttaccaagcctgaccacacagagggccttggccgcttccatggggaattggaaagcaataagatagcatcccctagaagcccagtgaagtctgggacaggacccttctctgagctctgacttgctcttggaaacacttcgaggcttagcctccccactttgtttcccgagagtgtgacctgttcccctccaaacacccccttctcctccagggccatgcccacccgtcaaaatcccccacgggcaggacgaactgtgggtgtcagtcaccatctatcctgcatcctggttccagggccccccccagccccgcctccatagggacaggcgtgcagacacccgtccctggctgcttcctcttgtggaatgggttcaaaagtaagcagtgttgtttacactgacaaactgaaaaaaaaagaaaaagagataacattggaggcttggcacagtggctcatgcctgtaatcccagcactttgggaggctaaggtgggaggatgtccccagcccaagagttctagaccagcctgggcaacatagcaagaccccatctcaaaaaaaaaatttaattggccaggcagaggtgggaggatcacttgaacccaaagggtggaggctgcagtgagccgtgatggcaccactgcactccagccagggcaacagagggagaccctgtctctaaaacaaacaaacaaacaaacaaacaaaagagttaacattggccagattaggattcaccagatagtgttaatattagtttgatttgagactttaatcagaaagcacatgtgtggtgggggtgggtgtaacctaagtcaggtagaatctttccaacttggggggggcacactcctgattgtagccatatgagtctgtcagtgtggtggaagaggccatgggttaatgggcaggtaaaaaagcaccttgcctggaattgagtagaaagtaaggcccttcagaccccgtgacacacttggggacattttcttgagtaacatcctaagattcatgtaccttgatgatctccatcaacttactcatgtgaagcacctttaaaccagtcgtctccaaattcaggggcacagtaacatccaacaggctggagaaagaacgtactagaacttccattcctttttcatgtcctcttctaaaagctttgtcagggccaggcgcggtggctcacgcctgtaatcccagcactttgggaggccgagacgggtggatcacgaggtcaggagatcgagaccatcctggctaacacagtgaaaccccatctctactaaaaatacaaaaaaacgagccgggcgtggtggtgggcgcctgtagtcccagctactcgggaggctgaggcaggagaatggcgtgaacccaggaggcagagcttgcagtgagccgagattgcaccactgcagtccagcctgggcgacagagcgagactccgtctcaaaaaagaaaaagaaaaagaaaaagaactgtgattggggaggacggtcactttcctgttcttactgatcagaagggatattaagggtacctgattcaaacagcctggagatcactgctttcaaccattacctgccttatttatttttagttactgtccttttttcagtttgtttccctcctccatgtgctgacttttattttgattttatttatgtttatgtttaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaaggtaaggaaaccacctttgaaaagaaccaggctgctctgctgtggtttgcaaatgtggggtttgtttatttgttttttagcctcaaagacctttcttcaaatgagttctggcatagaagcaccgtgtaaaatagttagaattctgggcaaaggggaaaagagagctgggggccatccctctcagcaccccacaggctctcatagcagcagctcctaagacacctggtgggaccttggtttcgaaatcgctactctaaggctgggcacggtggctcacacctgtaatcccagctctttaggaggccgaggagggtggatcacctgagatcaggagttcgagaccagcctggctaacatggcaaaaccctgtctctactaaaaatacaaaaattagccgggcgtggtggtatgcgtggtggtaatcgcagctactcgggaggctgaggcacaaggattgcttgaaccccagaggcagaggttgtagttagctccagcttgggcgacagagcaagaccctgtcgcaaaaattgtttaaaaaacaaacccaaaattgctactctcattgggttcctttgcccattcctgattttggcaagagaaatgcttccagattgccctgatctgggtaggacagcatcacgccatagcaacactgccccgtgagctcactgccccctcaactagcttgtggtccttggttaatgtcagtttcttttttgagtttgtgttatgtctaagggtcatctgctgggtaacggaacccagggactgccctagtccctagactgtgccatgcccgactctgccagctttgtcagtgatgctggtgctcgcctcctcgggtgctcgcctggtctgagcacacccaaggagttcttgaggccttagggttgtttgcgagagaatgaaagaacacgacctagctctctttagcatccttggtcaggttcaacactgcccccaggggcctctggtggagccaaccaccatcagccaaataaatccataattagagtcagaaaatggatgtctgcatatgtgtagtgcactaatgtcctgccgatgattgacatggagtggagagtgacctgatcattgctgtgagctctgctggccttggcacaactcatgctgataactaatgcacacagttcctctgggaggaaatgtcctcagggaacttggagtttgggtggggatgtgggtttgtgtgcccagcaagcccttgtggttgtagcagacactagtggcatctaggaggcaaagggtcaccccagtcttagccacgttttgagtcaaggtggcggagtggggctggtgttgactcttggtggcagtaacttttcccaatggtgaaaaacccctctatcatgtttcatttacagggggctgatggtaaaacgaagatcgccacaccgcggggagcagcccctccaggccagaagggccaggccaacgccaccaggattccagcaaaaaccccgcccgctccaaagacaccacccagctctggtaagaagaacgttctcttgaatcttagaggaagctgaagctctcagaggtacagccttcattttaggaggccttaggccactgagaatgaataacccctggcagctggtcagcagcttgcagtttactaagcactggagtcttcattgccttctcagtccttttgatttctgaggcaaatgttgaatccctacctttttttttttttttcttttgagacagagtttcgcttttgttatccaggccggagtgcagtggtgtgatctcagctcactgcatcctccacctcccaggttcaagcgattctcctacctcagcctccctagtagctgggattacaggcacctgccactatgcccggctaattttttgtatttttagtagagacagggtttcaccatgttggccaggctggtctcgaacgcctgacctcaggtgatccacctgcctcggcctcccaaagtgctgggattacaggcatgagccaccactcccagcctgaatcctcactttttatcaatgaagaaattgaggctgattctgcagcatgataaaaaaaaatacagaaaaaggaaaaaaaagaaagaaatcgagcctctgagagtttgcttgactgagtctaaccagctcattttaaacccgaggaaaatgcagtcacatgactactaagtggcagctctcggagcctctctggccccaagtccagggttccatagaggcagccccagcatggcatgttttcagtccccaaatgagactctggagacaaatgtctctggagacagagcagcagcctggataagtcacaatgggtgacgtcactcagggctcaacccctgggcagcttaacttgctagggacgttaggagtctgctgcaaaacctgagggtcttagctgagcagtcacaggctgggcccgttgccctgggctcctgtgagtaaaacccagtcaattttgagtacccagtaaggcatccattgagttattttgcagccaggagtgctattaagaacagtcgcggctgggcgtggtggctcatgcctgtaatcccagcactttgggaggccaaggtgggcggatcacctgaggtcaggagttcgagaccagcttggccaacatggcaaaaccccgtctctaataaaaatacaaaataattagctgggcgtggtggcgggcgcctgtaatcccagcttctcaggagggtgaggaaggagaatcacttgaacccaggaggcagaggttgcagtgagctgagatcgcaccattgcactccagcctggatgacaaaagtgagattccttctcaaaaaaaaaaaaaaaaaaacagtcgtcctctttggggattagggacagcctgcctgcctgcccgagcacttctctcttccattgccccagtgaagtattccaggcccctgggtttagactctgcaccatgtaggggtgtctgacctgcacttgctccttggtggcacgggcagcctatggcacttgctgcgggctgtgaccaaagcctggcctggatcttggatcttggtgactctgcttctccctggcctgagggagctgcccagagcctgcccaccacctgctgcgtgtctttgcggtggcatttctcgcacacatgccgtgcagtggcacccccaaggatggccattcactaaggcccattgtttttgtcttttcgcttcgtgttttctggcctggtgtttttctcatatacatgtgatccagggataattcccagaattttgacaggattttaagtagcgtttggatcctgctgtttttttttcacttaacatcgggccagttgactcacactctgttttttgttgttgtttttttgagacggagtctcactgtgtcacccaggctgaagtgcagtggcacaatcttggcatactgcaacctctgcttcccaaattcaagcagttttcctgcctcagcctcctgagtagctgggactacaggcacaggccaccacgccctgctaatttttgtatttttagtaaagacagggtttcaccattttggccagcctagtctcgaactcctgacctcaagtgatccgcccacctcggcctcccaaagtgctgggattacaggggactcacactttgtaacaacctgaaacaacgtgatgcatttccctttgggtcttacctgctcttcggtggctgcctgcaggtggagagaccctcccccttgggcccctcgaccttgtttcagaatggggcccctgctgggccagctgtgggtgcctgccacgtgaaggactcattaaggccctgtttaagcctgatgataataaggctttcgtggatttttctctttaagcgactaagcaagtccagagaagaccaccccctgcagggcccagatctgagagaggtactcgggagcctacttcgctgggagcagcctccctttgcgtgtgtggccattcactggcttgtgtttctagagccgggaggacccttttctgcaatgcagggttcacacagggttcgcagcctgaagatggagcagtccgaattctcttccctgtgcagtttgcgcagctgtgtttgtctgatgggctttctaatcctgtgtgctctccttgacttcagggacaatggcattacaggcatgagccaccatgcctggctgtctccctatgtttcagatgaagacataggcttaaggaggtcaggtgacttgcccacgaccactctgtaaataagaggcatgaaaagtatttggagccaccaccaccaagcccactggtcaccctgggtctctgaagtcagggaggcaggaggatgggaggtctgaggaggcagagaggctgagcctggaggccctggaggccgaggccccatctgttgtttccttatgtggaaaataagaggcttcgtttgtcctattgccacagagcgtactacttcaggaacatccaagacatggaaatccgcagggcacggtggctcacgtctataatcccggcactttgggaggttgaggtgggagaatcgcttgaggccagaagttcaagaccagcctgagcaacatagtcagaccccgtctctataaaaaacattatttttaaaaaagacatggaagtcaaattctaaaaactggtgctggctgggtgcggtggctcatgcctataatcccagcactttgggaggccgaggcgggtggatcacctgaggtcaggagttcaagaccagcctggccaacatggtaaaacctctactaaagaaatctttactgaaaatacaaaaatccagtctctactaaaataagtctctactaaaaatacaaaaattagccaggcgtggtgctgcacacctgtaatatcagctactcgggaggctgaggcaggagactcgcttgatcccatgcagcggaggttgcagtgagccgagatcacgccattgcactccagcctgggcatcagaataagactccgtctcaaaaaaaaaaccacaaaaaaacaaaacaacaacaaaagaaaactagtgcttattcgtcactggccaagctgcccattggctacatgggtgcttcaaagagctgcccttctccaggtctggccagcaggtatgtgttacagcaaatgcctggggcagcggcaggggcattgctgcgggaagcttctggacttgcaggaaagctaagttctcagactgcaggggagctaagcacacctcggcacagggtgaggcctgcggttctcagacttcagtctttgtggagcttgagaaaaatgaggctttgcaggtcccacccctagagattctgctctatccactcttgaaggggatcgagaaatttgcattttgcaactcccactttcctccttgaaagctccggagattctgacgcagggttccgtgggccacactttggaaaatacagacccatgagatagaataccagactgttgaagtgtaacgggggcctgggaagtgcagtaacagaagcaagtttgagggtaaaggacacccagaggagggagggacagcatctgcatggagaggagaagagaccccccagcagcttccagggtgttggaagggtgcgctagtaactgctatgcatggcaggtggggaactgtacgtcagggcacagcagcatgaagcggtatggctcgtgtggacagctagggacaggcaggcgtggagcaggcatcctgttctgaaggccaaatcccacagaggagccagggtgctggcaggagccctgaactagccgaacagctgaacagctgaacattcaccctgtggggaaagggtcagaagcgtccaggcttgagggcacagctgggtctcgtcactgcatcacccttatttaggataaaggccctgaagaattgtattagaggttggcaaagcatatctaccacctcctggagccacgctggccgcagggattataattatttccattttcaaattaaggcctctgagctcagagaggggaagttacttgtctgaggccacacagcttgttggagcccatctcttgacccaaagactgtggagccgagttggccacctctctgggagcgggtattggatggtggttgatggttttccattgctttcctgggaaaggggtgtctctgtccctaagcaaaaaggcagggaggaagagatgcttccccagggcagccgtctgctgtagctgcgcttccaacctggcttccacctgcctaacccagtggtgagcctgggaatggacccacgggacaggcagcccccagggccttttctgaccccacccactcgagtcctggcttcactcccttccttccttcccaggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgagagtggctggctgcgcgtggaggtgtggggggctgcgcctggaggggtagggctgtgcctggaagggtagggctgcgcctggaggtgcgcggttgagcgtggagtcgtgggactgtgcatggaggtgtggggctccccgcacctgagcacccccgcataacaccccagtcccctctggaccctcttcaaggaagttcagttctttattgggctctccactacactgtgagtgccctcctcaggcgagagaacgttctggctcttctcttgccccttcagcccctgttaatcggacagagatggcagggctgtgtctccacggccggaggctctcatagtcagggcacccacagcggttccccacctgccttctgggcagaatacactgccacccataggtcagcatctccactcgtgggccatctgcttaggttgggttcctctggattctggggagattgggggttctgttttgatcagctgattcttctgggagcaagtgggtgctcgcgagctctccagcttcctaaaggtggagaagcacagacttcgggggcctggcctggatccctttccccattcctgtccctgtgcccctcgtctgggtgcgttagggctgacatacaaagcaccacagtgaaagaacagcagtatgcctcctcactagccaggtgtgggcgggtgggtttcttccaaggcctctctgtggccgtgggtagccacctctgtcctgcaccgctgcagtcttccctctgtgtgtgctcctggtagctctgcgcatgctcatcttcttataagaacaccatggcagctgggcgtagtggctcacgcctataatcccagcactttgggaggctgaggcaggcagatcacgaggtcaggagttcgagaccaacctgaccaacagggtgaaacctcgtctctactaaaaatacaaaaatacctgggcgtggtggtggtgcgcgcctataatcccagctactcaggaggctgaggcaggagaatcgcttgaacccaggaggcagaggttgcagtgagccgagatagtgccactgcactccagtttgagcaacagagcgagactctgtctcaaaacaaaataaaacaaaccaaaaaaacccaccatggcttagggcccagcctgatgacctcatttttcacttagtcacctctctaaaggccctgtctccaaatagagtcacattctaaggtacgggggtgttggggaggggggttagggcttcaacatgtgaatttgcggggaccacaattcagcccaggaccccgctcccgccacccagcactggggagctggggaagggtgaagaggaggctgggggtgagaaggaccacagctcactctgaggctgcagatgtgctgggccttctgggcactgggcctcggggagctagggggctttctggaaccctgggcctgcgtgtcagcttgcctcccccacgcaggcgctctccacaccattgaagttcttatcacttgggtctgagcctggggcatttggacggagggtggccaccagtgcacatgggcaccttgcctcaaaccctgccacctccccccacccaggatcccccctgcccccgaacaagcttgtgagtgcagtgtcacatcccatcgggatggaaatggacggtcgggttaaaagggacgcatgtgtagaccctgcctctgtgcatcaggcctcttttgagagtccctgcgtgccaggcggtgcacagaggtggagaagactcggctgtgccccagagcacctcctctcatcgaggaaaggacagacagtggctcccctgtggctgtggggacaagggcagagctccctggaacacaggagggagggaaggaagagaacatctcagaatctccctcctgatggcaaacgatccgggttaaattaaggtccggccttttcctgctcaggcatgtggagcttgtagtggaagaggctctctggaccctcatccaccacagtggcctggttagagaccttggggaaataactcacaggtgacccagggcctctgtcctgtaccgcagctgagggaaactgtcctgcgcttccactggggacaatgcgctccctcgtctccagactttccagtcctcattcggttctcgaaagtcgcctccagaagccccatcttgggaccaccgtgactttcattctccagggtgcctggccttggtgctgcccaagaccccagaggggccctcactggcctttcctgccttttctcccattgcccacccatgcacccccatcctgctccagcacccagactgccatccaggatctcctcaagtcacataacaagcagcacccacaaggtgctcccttccccctagcctgaatctgctgctccccgtctggggttccccgcccatgcacctctgggggcccctgggttctgccataccctgccctgtgtcccatggtggggaatgtccttctctccttatctcttcccttcccttaaatccaagttcagttgccatctcctccaggaagtcttcctggattcccctctctcttcttaaagcccctgtaaactctgaccacactgagcatgtgtctgctgctccctagtctgggccatgagtgagggtggaggccaagtctcatgcatttttgcagcccccacaagactgtgcaggtggccggccctcattgaatgcggggttaatttaactcagcctctgtgtgagtggatgattcaggttgccagagacagaaccctcagcttagcatgggaagtagcttccctgttgaccctgagttcatctgaggttggcttggaaggtgtgggcaccatttggcccagttcttacagctctgaagagagcagcaggaatggggctgagcagggaagacaactttccattgaaggcccctttcagggccagaactgtccctcccaccctgcagctgccctgcctctgcccatgaggggtgagagtcaggcgacctcatgccaagtgtagaaaggggcagatgggagccccaggttatgacgtcaccatgctgggtggaggcagcacgtccaaatctactaaagggttaaaggagaaagggtgacttgacttttcttgagatattttgggggacgaagtgtggaaaagtggcagaggacacagtcacagcctcccttaaatgccaggaaagcctagaaaaattgtctgaaactaaacctcagccataacaaagaccaacacatgaatctccaggaaaaaagaaaaagaaaaatgtcatacagggtccatgcacaagagcctttaaaatgacccgctgaagggtgtcaggcctcctcctcctggactggcctgaaggctccacgagcttttgctgagacctttgggtccctgtggcctcatgtagtacccagtatgcagtaagtgctcaataaatgtttggctacaaaagaggcaaagctggcggagtctgaagaatccctcaaccgtgccggaacagatgctaacaccaaagggaaaagagcaggagccaagtcacgtttgggaacctgcagaggctgaaaactgccgcagattgctgcaaatcattgggggaaaaacggaaaacgtctgttttcccctttgtgcttttctctgttttcttctttgtgcttttctctgttttcaggatttgctacagtgaacatagattgctttggggccccaaatggaattattttgaaaggaaaatgcagataatcaggtggccgcactggagcaccagctgggtaggggtagagattgcaggcaaggaggaggagctgggtggggtgccaggcaggaagagcccgtaggccccgccgatcttgtgggagtcgtgggtggcagtgttccctccagactgtaaaagggagcacctggcgggaagagggaattcttttaaacatcattccagtgcccgagcctcctggacctgttgtcatcttgaggtgggcctcccctgggtgactctagtgtgcagcctggctgagactcagtggccctgggttcttactgctgacacctaccctcaacctcaaccactgcggcctcctgtgcaccctgatccagtggctcattttccactttcagtcccagctctatccctatttgcagtttccaagtgcctggtcctcagtcagctcagacccagccaggccagcccctggttcccacatcccctttgccaagctcatccccgccctgtttggcctgcgggagtgggagtgtgtccagacacagagacaaaggaccagcttttaaaacattttgttggggccaggtgtggtggctcacacctaatcccaacacctggggaggccaaggcagaaggatcacttgagtccaggagttcaagaccagcctgggcaacatagggagaccctgtctctacaattttttttttaattagctgggcctgttggcactctcctgtagttccagctactctagaggctgaggtgggaggactgcttgagcctgggaggtcagggctgcaatgagccatgttcacaccactgaacgccagcctgggcgagaccctgtatcaaaaaagtaaagtaaaatgaatcctgtacgttatattaaggtgccccaaattgtacttagaaggatttcatagttttaaatacttttgttatttaaaaaattaaatgactgcagcatataaattaggttcttaatggaggggaaaaagagtacaagaaaagaaataagaatctagaaacaaagataagagcagaaataaaccagaaaacacaaccttgcactcctaacttaaaaaaaaaaatgaagaaaacacaaccagtaaaacaacatataacagcattaagagctggctcctggctgggcgcggtggcgcatgcctgtaatcccaacactttgggaggccgatgctggaggatcacttgagaccaggagttcaaggttgcagtgagctatgatcataccactacaccctagcctgggcaacacagtgagactgagactctattaaaaaaaaaatgctggttccttccttatttcattcctttattcattcattcagacaacatttatggggcacttctgagcaccaggctctgtgctaagagcttttgcccccagggtccaggccaggggacaggggcaggtgagcagagaaacagggccagtcacagcagcaggaggaatgtaggatggagagcttggccaggcaaggacatgcagggggagcagcctgcacaagtcagcaagccagagaagacaggcagacccttgtttgggacctgttcagtggcctttgaaaggacagcccccacccggagtgctgggtgcaggagctgaaggaggatagtggaacactgcaacgtggagctcttcagagcaaaagcaaaataaacaactggaggcagctggggcagcagagggtgtgtgttcagcactaaggggtgtgaagcttgagcgctaggagagttcacactggcagaagagaggttggggcagctgcaagcctctggacatcgcccgacaggacagagggtggtggacggtggccctgaagagaggctcagttcagctggcagtggccgtgggagtgctgaagcaggcaggctgtcggcatctgctggggacggttaagcaggggtgagggcccagcctcagcagcccttcttggggggtcgctgggaaacatagaggagaactgaagaagcagggagtcccagggtccatgcagggcgagagagaagttgctcatgtggggcccaggctgcaggatcaggagaactggggaccctgtgactgccagcggggagaagggggtgtgcaggatcatgcccagggaagggcccaggggcccaagcatgggggggcctggttggctctgagaagatggagctaaagtcactttctcggaggatgtccaggccaatagttgggatgtgaagacgtgaagcagcacagagcctggaagcccaggatggacagaaacctacctgagcagtggggctttgaaagccttggggcggggggtgcaatattcaagatggccacaagatggcaatagaatgctgtaactttcttggttctgggccgcagcctgggtggctgcttccttccctgtgtgtattgatttgtttctcttttttgagacagagtcttgctgggttgcccaggctggagtgcagtggtgcgatcatagctcactgcagccttgaagtcctgagctcaagagatccttccacctcagcctcctgagtagttgggaccacaggcttgcaccacagtgcccaactaatttcttatattttttgtagagatggggtttcactgtgtcgcccaggatggtcttgaactcctgggctcaagtgatcctcctgcctcagcctcgcaaattgctgggattacaggtgtgagccaccatgcccgaccttctctttttaagggcgtgtgtgtgtgtgtgtgtgtgtgggcgcactctcgtcttcaccttcccccagccttgctctgtctctacccagtcacctctgcccatctctccgatctgtttctctctccttttacccctctttcctccctcctcatacaccactgaccattatagagaactgagtattctaaaaatacattttatttatttattttgagacagagtctcactctgtcacccaggctggagtgcagtggtgcaatctcggctcactgcaacctccgcctcccaggttgaagcaactctcctgcctcagcctccctagtagctgggattacaagcacacaccaccatgcctagcaaatttttatatttttagtagaggaggggtgtcaccatgtttgccaagctggtctcaaactcctggcctcaggtgatctgcctaccttggtctcccaaagtgctgggattacaggtgtgagccaccacgcctgcccttaaaaatacattatatttaatagcaaagccccagttgtcactttaaaaagcatctatgtagaacatttatgtggaataaatacagtgaatttgtacgtggaatcgtttgcctctcctcaatcagggccagggatgcaggtgagcttgggctgagatgtcagaccccacagtaagtggggggcagagccaggctgggaccctcctctaggacagctctgtaactctgagaccctccaggcatcttttcctgtacctcagtgcttctgaaaaatctgtgtgaatcaaatcattttaaaggagcttgggttcatcactgtttaaaggacagtgtaaataattctgaaggtgactctaccctgttatttgatctcttctttggccagctgacttaacaggacatagacaggttttcctgtgtcagttcctaagctgatcaccttggacttgaagaggaggcttgtgtgggcatccagtgcccaccccgggttaaactcccagcagagtattgcactgggcttgctgagcctggtgaggcaaagcacagcacagcgagcaccaggcagtgctggagacaggccaagtctgggccagcctgggagccaactgtgaggcacggacggggctgtggggctgtggggctgcaggcttggggccagggagggagggctgggctctttggaacagccttgagagaactgaacccaaacaaaaccagatcaaggtctagtgagagcttagggctgctttgggtgctccaggaaattgattaaaccaagtggacacacacccccagccccacctcaccacagcctctccttcagggtcaaactctgaccacagacatttctcccctgactaggagttccctggatcaaaattgggagcttgcaacacatcgttctctcccttgatggtttttgtcagtgtctatccagagctgaagtgtaatatatatgttactgtagctgagaaattaaatttcaggattctgatttcataatgacaaccattcctcttttctctcccttctgtaaatctaagattctataaacggtgttgacttaatgtgacaattggcagtagttcaggtctgctttgtaaatacccttgtgtctattgtaaaatctcacaaaggcttgttgccttttttgtggggttagaacaagaaaaagccacatggaaaaaaaatttcttttttgtttttttgtttgcttgtttttttgagacagagtttcactctgtcgcccaggctggagtgcagtggtgcgatctccgcccactgcaagctccacctcccgggttcatgctattctcctgtctcagcctcccaagtagctgggactgcaggtgcccgccaccacacctggctaatttttttgtatttttagtagagacggggtttcaccgtgttagccaggatggtctcaatctcctgacctcgtcatctgcctgcctcggcctcccaaagtgctgagattacaggcgtgagccaccgtgcccggccagaaaaaaacatttctaagtatgtggcagatactgaattattgcttaatgtcctttgattcatttgtttaatttctttaatggattagtacagaaaacaaagttctcttccttgaaaaactggtaagttttctttgtcagataaggagagttaaataacccatgacatttccctttttgcctcggcttccaggaagctcaaagttaaatgtaatgatcactcttgtaattatcagtgttgatgcccttcccttcttctaatgttactctttacattttcctgctttattattgtgtgtgttttctaattctaagctgttcccactcctttctgaaagcaggcaaatcttctaagccttatccactgaaaagttatgaataaaaaatgatcgtcaagcctacaggtgctgaggctactccagaggctgaggccagaggaccacttgagcccaggaatttgagacctgggctgggcagcatagcaagactctatctccattaaaactatttttttttatttaaaaaataatccgcaaagaaggagtttatgtgggattccttaaaatcggagggtggcatgaattgattcaaagacttgtgcagagggcgacagtgactccttgagaagcagtgtgagaaagcctgtcccacctccttccgcagctccagcctgggctgaggcactgtcacagtgtctccttgctggcaggagagaatttcaacattcaccaaaaagtagtattgtttttattaggtttatgaggctgtagccttgaggacagcccaggacaactttgttgtcacatagatagcctgtggctacaaactctgagatctagattcttctgtggctgcttctgacctgagaaagttgcggaacctcagcgagcctcacatggcctccttgtccttaacgtggggacggtgggcaagaaaggtgatgtggcactagagatttatccatctctaaaggaggagtggattgtacattgaaacaccagagaaggaattacaaaggaagaatttgagtatctaaaaatgtaggtcaggcgctcctgtgttgattgcagggctattcacaatagccaagatttggaagcaacccaagtgtccatcaacagacaaatggataaagaaaatgtggtgcatatacacaatggaatactattcagccatgaaaaagaatgagaatctgtcatttgaaacaacatggatggaactggaggacattatgttaagtgaaataagccagacagaaggacagacttcacatgttctcacacatttgtgggagctaaaaattaaactcatggagatagagagtagaaggatggttaccagaggctgaggagggtggaggggagcagggagaaagtagggatggttaatgggtacaaaaacgtagttagcatgcatagatctagtattggatagcacagcagggtgacgacagccaacagtaatttatagtacatttaaaaacaactaaaagagtgtaattggactggctaacatggtgaaaccccgtctctactaaaaatacaaaaattagctgggcatggtggctcacgcctgtaatcccagcactttgggaggccgaggcgggccgatcacgaggtcaggagatcgagaccatcctagctaacatggtgaaaccccgtctctactacaaatacaaaaaaaagaaaaaattagccgggcatggtggtgggcgcctgtagtcccagctactcgggaggctgaggcaggagaatggcgtgaacccgggaggcggagcttgcagtgagccgagatcgcgccactgcactccagcctgggcgacaaggcaagattctatctcaaaaaaataaaaataaaataaaataaaataataaaataaaataaaataaaataaaataaataaaataaaataaaatgtataattggaatgtttataacacaagaaatgataaatgcttgaggtgatagataccccattcaccgtgatgtgattattgcacaatgtatgtctgtatctaaatatctcatgtaccccacaagtatatacacctactatgtacccatataaatttaaaattaaaaaattataaaacaaaaataaataagtaaattaaaatgtaggctggacaccgtggttcacgcctgtaatcccagtgctttgtgaggctgaggtgagagaatcacttgagcccaggagtttgagaccggcctgggtgacatagcgagaccccatcatcacaaagaatttttaaaaattagctgggcgtggtagcacataccggtagttccagctacttgggagaccgaggcaggaggattgcttgagcccaggagtttaaggctgcagtgagctacgatggcgccactgcattccagcctgggtgacagagtgagagcttgtctctattttaaaaataataaaaagaataaataaaaataaattaaaatgtaaatatgtgcatgttagaaaaaatacacccatcagcaaaaagggggtaaaggagcgatttcagtcataattggagagatgcagaataagccagcaatgcagtttcttttattttggtcaaaaaaaataagcaaaacaatgttgtaaacacccagtgctggcagcaatgtggtgaggctggctctctcaccagggctcacagggaaaactcatgcaacccttttagaaagccatgtggagagttgtaccgagaggttttagaatatttataactttgacccagaaattctattctaggactctgtgttatgaaaataacccatcatatggaaaaagctcctttcagaaagaggttcatgggaggctgtttgtattttttttttctttgcatcaaatccagctcctgcaggactgtttgtattattgaagtacaaagtggaatcaatacaaatgttggatagcaggggaacaatattcacaaaatggaatgggacatagtattaaacatagtgcttctgatgaccgtagaccatagacaatgcttaggatatgatatcacttcttttgttgttttttgtattttgagacgaagtctcattctgtcacccaggctggagttcagtggcgccatctcagctcactgcaacctccatctcccgggttcaagctattctccttcctcaacctcccgagtagctgggttgcgcaccaccatgcctggctaacttttgtatttttagtacagacggggtttcaccacgttggccaggctgctcttgaactcctgacgtcaggtgatccaccagccttgacctcccaaagtgctaggattacaggagccactgtacccagcctaggatatgatatcacttcttagagcaagatacaaaattgcatgtgcacaataattctaccaagtataggtatacaggggtagttatatataaatgagacttcaaggaaatacaacaaaatgcaatcgtgattgtgttagggtggtaagaaaacggtttttgctttgatgagctctgttttttaaaatcgttatattttctaataaaaatacatagtcttttgaaggaacataaaagattatgaagaaatgagttagatattgattcctattgaagattcagacaagtaaaattaaggggaaaaaaaacgggatgaaccagaagtcaggctggagttccaaccccagatccgacagcccaggctgatggggcctccagggcagtggtttccacccagcattctcaaaagagccactgaggtctcagtgccattttcaagatttcggaagcggcctgggcacggctggtccttcactgggatcaccacttggcaattatttacacctgagacgaataaaaaccagagtgctgagattacaggcatggtggcttacgcttgtaatcggctttgggaagccgaggtgggctgattgcttgagcccaggagtttcaaactatcctggacaacatagcatgacctcgtctctacaaaaaatacaaaaaatttgccaggtgtggtggcatgtgcctgtggtcccagctacttgggaggctgaagtaggagaatcccctgagccctgggaagtcgaggctgcactgagccgtgatggtgtcactgcactccagcctgggtgacaaagtgagaccctatctcacaaagaaaaaaaacaaaacaaaaaacccaaagcacactgtttccactgtttccagagttcctgagaggaaaggtcaccgggtgaggaagacgttctcactgatctggcagagaaaatgtccagtttttccaactccctaaaccatggttttctatttcatagttcttaggcaaattggtaaaaatcatttctcatcaaaacgctgatattttcacacctccctggtgtctgcagaaagaaccttccagaaatgcagtcgtgggagacccatccaggccacccctgcttatggaagagctgagaaaaagccccacgggagcatttgctcagcttccgttacgcacctagtggcattgtgggtgggagagggctggtgggtggatggaaggagaaggcacagcccccccttgcagggacagagccctcgtacagaagggacaccccacatttgtcttccccacaaagcggcctgtgtcctgcctacggggtcagggcttctcaaacctggctgtgtgtcagaatcaccaggggaacttttcaaaactagagagactgaagccagactcctagattctaattctaggtcagggctaggggctgagattgtaaaaatccacaggtgattctgatgcccggcaggcttgagaacagccgcagggagttctctgggaatgtgccggtgggtctagccaggtgtgagtggagatgccggggaacttcctattactcactcgtcagtgtggccgaacacatttttcacttgacctcaggctggtgaacgctcccctctggggttcaggcctcacgatgccatccttttgtgaagtgaggacctgcaatcccagcttcgtaaagcccgctggaaatcactcacacttctgggatgccttcagagcagccctctatcccttcagctcccctgggatgtgactcaacctcccgtcactccccagactgcctctgccaagtccgaaagtggaggcatccttgcgagcaagtaggcgggtccagggtggcgcatgtcactcatcgaaagtggaggcgtccttgcgagcaagcaggcgggtccagggtggcgtgtcactcatccttttttctggctaccaaaggtgcagataattaataagaagctggatcttagcaacgtccagtccaagtgtggctcaaaggataatatcaaacacgtcccgggaggcggcagtgtgagtaccttcacacgtcccatgcgccgtgctgtggcttgaattattaggaagtggtgtgagtgcgtacacttgcgagacactgcatagaataaatccttcttgggctctcaggatctggctgcgacctctgggtgaatgtagcccggctccccacattcccccacacggtccactgttcccagaagccccttcctcatattctaggagggggtgtcccagcatttctgggtcccccagcctgcgcaggctgtgtggacagaatagggcagatgacggaccctctctccggaccctgcctgggaagctgagaatacccatcaaagtctccttccactcatgcccagccctgtccccaggagccccatagcccattggaagttgggctgaaggtggtggcacctgagactgggctgccgcctcctcccccgacacctgggcaggttgacgttgagtggctccactgtggacaggtgacccgtttgttctgatgagcggacaccaaggtcttactgtcctgctcagctgctgctcctacacgttcaaggcaggagccgattcctaagcctccagcttatgcttagcctgcgccaccctctggcagagactccagatgcaaagagccaaaccaaagtgcgacaggtccctctgcccagcgttgaggtgtggcagagaaatgctgcttttggcccttttagatttggctgcctcttgccaggagtggtggctcgtgcctgtaattccagcactttgggagactaaggcgggaggttcgcttgagcccaggagttcaagaccagcctgggcaacaatgagacccctgtgtctacaaaaagaattaaaattagccaggtgtggtggcacgcacctgtagtcccagctacttgggaggctgaggtgggaggattgcctgagtccgggaggcggaagttgcaaggagccatgatcgcgccactgcacttcaacctaggcaacagagtgagactttgtctcaaaaaacaatcatataataattttaaaataaatagatttggcttcctctaaatgtccccggggactccgtgcatcttctgtggagtgtctccgtgagattcgggactcagatcctcaagtgcaactgacccacccgataagctgaggcttcatcatcccctggccggtctatgtcgactgggcacccgaggctcctctcccaccagctctcttggtcagctgaaagcaaactgttaacaccctggggagctggacgtatgagacccttggggtgggaggcgttgatttttgagagcaatcacctggccctggctggcagtaccgggacactgctgtggctccggggtgggctgtctccagaaaatgcctggcctgaggcagccacccgcatccagcccagagggtttattcttgcaatgtgctgctgcttcctgccctgagcacctggatcccggcttctgccctgaggccccttgagtcccacaggtagcaagcgcttgccctgcggctgctgcatggggctaactaacgcttcctcaccagtgtctgctaagtgtctcctctgtctcccacgccctgctctcctgtccccccagtttgtctgctgtgaggggacagaagaggtgtgtgccgcccccacccctgcccgggcccttgttcctgggattgctgttttcagctgtttgagctttgatcctggttctctggcttcctcaaagtgagctcggccagaggaggaaggccatgtgctttctggttgaagtcaagtctggtgccctggtggaggctgtgctgctgaggcggagctggggagagagtgcacacgggctgcgtggccaacccctctgggtagctgatgcccaaagacgctgcagtgcccaggacatctgggacctccctggggcccgcccgtgtgtcccgcgctgtgttcatctgcgggctagcctgtgacccgcgctgtgctcgtctgcgggctagcctgtgtcccgcgctctgcttgtctgcggtctagcctgtgacctggcagagagccaccagatgtcccgggctgagcactgccctctgagcaccttcacaggaagcccttctcctggtgagaagagatgccagcccctggcatctgggggcactggatccctggcctgagccctagcctctccccagcctgggggccccttcccagcaggctggccctgctccttctctacctgggacccttctgcctcctggctggaccctggaagctctgcagggcctgctgtccccctccctgccctccaggtatcctgaccaccggccctggctcccactgccatccactcctctcctttctggccgttccctggtccctgtcccagcccccctccccctctcacgagttacctcacccaggccagagggaagagggaaggaggccctggtcataccagcacgtcctcccacctccctcggccctggtccaccccctcagtgctggcctcagagcacagctctctccaagccaggccgcgcgccatccatcctccctgtcccccaacgtccttgccacagatcatgtccgccctgacacacatgggtctcagccatctctgccccagttaactccccatccataaagagcacatgccagctgacaccaaaataattcgggatggttccagtttagacctaagtggaaggagaaaccaccacctgccctgcaccttgttttttggtgaccttgataaaccatcttcagccatgaagccagctgtctcccaggaagctccagggcggtgcttcctcgggagctgactgataggtgggaggtggctgcccccttgcaccctcaggtgaccccacacaaggccactgctggaggccctggggactccaggaatgtcaatcagtgacctgccccccaggccccacacagccatggctgcatagaggcctgcctccaagggacctgtctgtctgccactgtggagtccctacagcgtgccccccacaggggagctggttctttgactgagatcagctggcagctcagggtcatcattcccagagggagcggtgccctggaggccacaggcctcctcatgtgtgtctgcgtccgctcgagcttactgagacactaaatctgttggtttctgctgtgccacctacccaccctgttggtgttgctttgttcctattgctaaagacaggaatgtccaggacactgagtgtgcaggtgcctgctggttctcacgtccgagctgctgaactccgctgggtcctgcttactgatggtctttgctctagtgctttccagggtccgtggaagcttttcctggaataaagcccacgcatcgaccctcacagcgcctcccctctttgaggcccagcagataccccactcctgcctttccagcaagatttttcagatgctgtgcatactcatcatattgatcacttttttcttcatgcctgattgtgatctgtcaatttcatgtcaggaaagggagtgacatttttacacttaagcgtttgctgagcaaatgtctgggtcttgcacaatgacaatgggtccctgtttttcccagaggctcttttgttctgcagggattgaagacactccagtcccacagtccccagctcccctggggcagggttggcagaatttcgacaacacatttttccaccctgactaggatgtgctcctcatggcagctgggaaccactgtccaataagggcctgggcttacacagctgcttctcattgagttacacccttaataaaataatcccattttatcctttttgtctctctgtcttcctctctctctgcctttcctcttctctctcctcctctctcatctccaggtgcaaatagtctacaaaccagttgacctgagcaaggtgacctccaagtgtggctcattaggcaacatccatcataaaccaggtagccctgtggaaggtgagggttgggacgggagggtgcagggggtggaggagtcctggtgaggctggaactgctccagacttcagaaggggctggaaaggatattttaggtagacctacatcaaggaaagtgttgagtgtgaaacttgcgggagcccaggaggcgtggtggctccagctcgctcctgcccaggccatgctgcccaagacaaggtgaggcgggagtgaagtgaaataaggcaggcacagaaagaaagcacatattctcggccgggcgctgtggctcacgcctgtaattccagcactttgggaggccaaggtgggtggatcatgaggtcaggagattgagaccatcctggctaacacagtgaaaccccgtctctactaaaaatacaaaaaattagccgggcgtggtggtgggcgcctgtagtcccagctactccggaggctgaggcaggaaaatggcgtgaacccggaaggcggagcttgcagtgagcggagtgagcagagatcgcgccactgcactccagcctgggcgacagagcgagactccgtctcaaaaaaaaaaagcacatgttctcgcttctttgtgggatccaggagatagagaatagaaggatggttaccagaggctgggaagggtagtgaggggatggtggggggatggtcaatgggtacaaaaaaaatagaataagacctagtatttgatagtgcaacagggtgactatagtcaataataatttaattgtacatttaaaaataactaaaagatagccgggtgcagtggcttacgtctgtaatcccagtactttgggaggctgaggtgggcgtttgagaccagcctggccaacatggtgaaaccccatctctactaaaaatacaaaaattagccaggcatggtggcgggcgcctgtaatcccagctactcgggaggctgaggcaggagaatcacttgaacctgggaggcagaggttgcagtgagccgagatcttgccactgcactccagcctgggtgacagtgaaactccgtctcaaaaataaaaataaaaatacagctgggcacggtggctcacgcctgtaatcccagcactttgggaggccgaggcgagcggatcacaaggtcaggagatatagaccatcctggctaacacggtgaaacccggtctctactaaaaatacaaaaaattagccaggcgtggtggcaggtgcctatagtcccagctactcacaaggctgaggcaggagaatggcatgaacctgggaggcggagcttgcagtgagccgagattgtgccactgcactccagcctgggcgagagagtgagactccgtctcaaaacaaaaacaaaaacaaaaacaaaaacaaacacacaacaaaaacctaaaagaatataaatggattgtttgtaacacaaaggacaaatgtttgaggggatggataccccattttccatgatgtgattattatacattgtgtgtctgtatcaaaacatctcatgagccccataaatatatacacctaactatgtacccacaaaaattaaaaaaatatattttttaaggtgaagagggaggcgagatgctggccttaacccctaacccgttgttctccctgcaagctgtccacagggcctctcagactcgaggttcagctatatggatgcatgagcttggtccccagccaacatgggagacacttcaccatcggcagcagctacagcacaggaaccctgggtcactgccatgtcccctctgtgactttgtttaaacagaaaatgatgctctgggccggctgtggtggcccacacctataatcccagcaccttgggaggcgggggtgggcagattgcctgaggtcaggagttggagatcagcctggccgacatggcgaaaccccatgtctactaaaaatacaaaaactagccaggcatggtggcacatgcctgtaatcccagctacttgggaggctgaagcaggagaatcacttgaacccaggaggcagaggctgagtgagccaagatcgtgccaatgcactccagcttgggtgagggagtgagactccgtctcaaaaaaaaaaaaaaagaaagaaaaagaaaagaaagtgatcctactggaaccatgcttactcccctccccacctcacactgtgtagaaattagtgctgtcggccaggcgcggtggctcatgcctgtaatcgcagcactttgggaggccaaggcaggcggatcacgaggtcaggagatcaagaccatcctggctaacacagtgaaaccctgtctctactaaaaatacaaaaaattagccgggcatggtggcaggcacctgtagtcccaactacttgggaggctgaggcaggagaatggcatgaacctgggaggcggagcttgcagtgagccaagatcgcgccactgcataccagcctaggtgacagagtgagactcagcaaaaaaagaaagaaagaaagaaagaaatcagtgctgtctatacttctttctgcagtgatggaaatattctgtatctgtgctgtccagtatagtagccactagctacatgtggcacttgaaacatggctggtacagttgaggaagagtggctgccatatcggacgacacagctatagattctgtcaccccaccccgagagtccagagcggggacttctgccttaggccctattcagggctgatttttacttgaacccttactgtgggaagagaaggccatgagaagttcagtctagaatgtgactccttattttctggctcccttggacactttgtgggatttagtctccctgtggaaagtattccacaagtggtgccaccaccccagctgtgagagcagctgggagctgcttttgtcatctttccctggaaagtcctgtgggctgtctcttcctcatgccttgtcccatgcttgggcatggtgtcaagcgtcaggagggagaaagggtccttatttatttatttagagagggacccttcttctgttcccaggctggagtgcagtggtgcgatctcggctcactgcaacctccgcctcctgggttcaagtgattctcctgcctcagcctcctgagtagctgagattacaggcacatgccaacatgcctggctaattttttttttttttttttttttttttttttgagatggagttgtactctcattgcccaggctggaatgtaatggcacaatctcggctcactgcaacctccacctcctggattcaagcaattctcctgtctcagcttcccaagtagctgggattacaggtgcccgccaccatgctcaactaatttttgtattttttttttagtagagacgaggtttcaccatgttggtcagactggtctcaaactcctgacctcaggtgatccacctgcctcggcctcccaaagtgctaggattacaggcatgagccaccacgcccggcctgaaagggttcttatttagtgtgcattttgacattcaatttaattccaaggtcttgtggggtcatggtttacaggatgttgatatagaaaagacttcacttaatgggccgggcgcagtggctcatgcctgtaatcccagcactttgggaggccgaggcaggcagatcaggaggtcaggagattgagaccatcctggctaacacagtgaaaccccatctctactgaaaatacaaaaaattagctgggcgtggtggcaggcacctgtagtcccagccactcggttggctgaggcaggagaatggcatgaacccgggaggcggagcttgcagtgagcagagaccatgccactgcactccagcctgggcgacagagcaagactctgtctcaagaaaaaaaaaaaaaaaacagactttacttactggaagccaaccaatgtatatttagagtaatttttcctgggctgagctgtcatttacttttgcagtatctcaagaagaagagtttacagtgtaaatatttgatgcacactttgattatatagatgaagcaaactattttcaagagctttgcaaggacttacttgtatccaaacaccattctaaaggagtcttacctacttctaaaggctggtctctacttggaaccacttgcttggccctggttcaagtcctgctgcaaacctggaagtcctgtcattgtcttcttccctccagagcagtggcacccaatctaatttttgctgtgccccagcagcccctggcactttgccctgtagactgcagacctcatgtaatgtatgttaagtccacagaaccacagaagatgatggcaagatgctcttgtgtgtgttgtgttctaggaggtggccaggtggaagtaaaatctgagaagcttgacttcaaggacagagtccagtcgaagattgggtccctggacaatatcacccacgtccctggcggaggaaataaaaaggtaaagggggtagggtgggttggatgctgcccttgggtatatgggcattaatcaagttgagtggacaaaggctggtccagttcccagaggaggaaaacagaggcttctgtgttgactggctggatgtgggccctcagcagcatccagtgggtctccactgcctgtctcaatcacctggagctttagcacgtttcacacctgggccccaacctggagaggctgaccaatgggtctcaggggcagctcggttgctggagtttttgtttttatttatttttatgtatttaaggcagggtctctgtattagtccattctcacactgctaataaagacatacccaagactgggtaatttataaaggaaagaggtttaatggactcacagttccacatggctggggaggcctcaaaatcatggcggaaggcaaaggagaagcaaaggcatttcttacatggcgacaggcaagagagcgtgtgcaggggaactcccatttataaaaccatcagacctcatgagatttattcactatcatgagaacagcatgggaaagacccgcccccatgattcagttacctcccactgggtccctcccatgacacatggaattatgggagctacaattcaagatgagatttgggtggggacacagccaaaccatatcagtctccctctgtcatccaggctggagtgcactggcatgatctcggctcactgcagcctctacctccctgggtcaggtgatcttcccacctcagcctcccaggtagctggaactacaggtacctgccactatgcctggctaaatattttgtatttcctgtggagacgaggttttgccacgttgcccaggctggtcttgaactcctgaggtcaagcaatatgcccacctcggcctcccaaggtgctgggattacaggtgtgagccacagtgctcggcctaagtcactgcagtttttaaagctcccaggtgattcttcagtgcagtcaaaagtgagaactggctgggtgcggtggctcatgcctgtaatcccagcaccttgggaggcgaaggtgggcagatggcttgaggtcaggagttcaagaccagcctggccaacatggtaaaaccccatctctactaaaaatacaaaagttagctgggtgtggtggtgcgtgcctgtaatcccagctacttgggaggctgaggcatgagaattgcttgaacccaggggacagaggttgtagtgagccgagatcgtgccactgcactccagcctgggcaacagagtgagattccatctcacaaaaaaaaaaaaaaaagcgagaaccactgtcctaggccctgatgtttgcaggcaactaaaaaaggaagtggacatccccagtcagctgtggcgcaccaagaacaagtcatgggaacataacctaattttctaaatgggttactaggcacttagagcaaaacaatgatgccgaaatcctgatttcagcaaagcctctgcctgcctgtcttggaagtatccacatgaggctgctggggccttggtgtccccagcagtttctagtctctaggtcttgctgtgggtgtctgtgcagtgagggtgtgtgtggcgctgggtgagctctgtctaggcctggcacaggatgcggtctggtagctgctgcttctcttctgcagaagcgcagccaagcaccctctggggtttcaggcccacacccagcctgaagttctgggagtggctcactttccaaccttcagggtctcccagcagctgactggggagtggtggagggaaaagggattgtattagtccgttttcacgccgctgatgaagacatacccgatactgggcagtctaaaagatagaggtctgatggactcacagttccacgtgactggggaggcctgacaatcatggtggaaggtgaaaggcttgtctcacacggtggcagacaagagaaaagagcttgtgcaggggaactcccctttataaaaccatcagatctcgggagacttattcactatcatgagaacagcacgggaaagaccctcctctatgattcaattacctcccaccaggtccctcccacaacatgtaggaattgtgggaactacaattcaagatgacatttgggtggggacacagccaaaccatatcagggcgtcccagaaagggtatagggtctgagacccaagtcagcatgagaaagtatgcttctcatggtggcccagttgggtggaagtggcagccgggccgtctttccaccaggccactcaagtagcagctgagagacccctgccctggccagtccccgccctcccctcttgccactgcctctggttctgaacagatgggcaccctcatcttgtatttgtgattaatgtctaacaatgtagttttgtgagaagggtttgctgatacagccttgctgcagatgctgcgaactgtggcctggggcagaccttacctccagacacgccctgaggcaggggagggcactggcccgtagctggccgagagctctcgggttgcgcgacagggatacttttcagcggctgggtcgctatccaaagtgagaaaacgaggagggaccaggaggctgtccgcctcaagagatgtgggggccaggtccagttatctggggaagcagtaagcttctctgctgtttctaaccccaggcctcccctggtctaaggcagggcctcccagcctcggggcactttaaagatatctgggcctggccccatccccacagtctgactgagtgggtctggatagggcctgagcattggtgatttcctgggtgaaaggaggcccctcacagtctctggaagcttctctgtgttaggaaaagctctgggcttgactctgctttgaaagtcaagatccgcaaatcctctcagcctcagtttctccttcagcaagatgaaatggaaatgctgtacctacgtcccggggtggttgtgagacccaaaaaagacaatgttctggaaggttcctggtgcgttgcagtcctctaagaacctgagttagagccacgctgagtctcagcttcttggctccttctgtttcaaactcgtccatgtgatagctcaggaagggtaggcagggccctgccccctactcagaaaacaccatcctggtcctggggatccccgcagcattagtcccctgttttcccagtgtattgagaaaaattgctaacaagcagtggggcacaccaccagcctcctgggttcctttcagtttggggatttttggacattcccaggaatgtcttaaaaaacacttcaaaaaacattaacataaatatttttatcaaagcctgtattaaatggtctttcaagaaaatacagtaacaggtcaggcatggtggctcatgcctgtaaccccagcactttgggaggccaaggcaggcagatcacctgaaatcaggagttcaagaccaacctggccaacacagccaaatcccatctctacaaaaaatacaaaaattagctgggtgtggtggcacacacctgtagtcccagctacttgggaggccgaggcaggagaattgcttgatcccggaggcggaggttgcagtgagctgagatcgtgccactgcactccagcgtgggtgacaaggtgaatctttgtctcaaaaaaaaaaaaaaaaaaaagataaaatacagtatacagtaatagagaacaatccttttttcaaagtagtgaccccaaatgaacaaaatatgcatctagcttaaatgcgaacctggttttctctacgcccattcaagcccctgcaataggggcccttcaccccgcatccatggactcctaaaattatatggaaaatggctgtgtgtgagtgtggatggacatgtgcacacatatttttggctttaccagatgctcaaagagcctaggacccaaaaagggctgagaatgaccgtgtcggccacttcagggtcatcaggaattgctgtgcactgctcacttctccagtgaacactttctgcttctgtgtttcctggtatcctttgggactcctggctaggtcatgtgtttctctactttcaaaagggcttcagccaggcacgatggcatgagcctgtagtcccagttgctctggaggttaaggtgggaagattgcttgagcccaggaatttgaggccagcctgggcaagtagataggtagatgattgatagatagatagatagataaatagatggatagataagtcgctagacagtcatccatccacccatccacacataaaaaggcctttgtcatgtcatgttttgtggcccacctgccagtgttgcccacagttgctgcccctccaaactcatcagtcactggcaaacaggaggaatgtgtggctcatgtctgggcatcagtggctgtgggagacatccttgatcttctccagcttctccttccacattttcctttgcaatctggcaatatctattaaaataaaatgtgcatgccttttgacctaagagcttcacttctaggacccacttacacgtgtgtgacatgatgttcatacgggtttatttatctgaggttgttcatacacaccattgcctgtaatcactaaaggcgggagcagcctacacatccatccacagaggagtagatgccttttggtacatccgtggcgacggaatactaagcagcctgtgtatctatacactcacacgtgtttgtttatgtgtggaatatctctggagggtacacaagaaacttaaaatgatcactgtctctggggagggtacctgggtgcctgggaggcaggtcagggaaggagtgggcacaggtattaccaattggaagacaataaaaacaacagctcctggccaggcgcagtggctcacgcctgtaatggcagcactctgagaggctgaggcgggcagattgcttgcgtccaggagttcaagaccagcctgggcaacatagcaaaaccccgtttctattaaaaatacaaaaaattagccaggtgtggtggcatgcacctgtaatcccagctactcgggaggctgaggtgggagaatcacctgagcctgggaggtcaaggctgcagtgaggtgagattgtgccaccgcactctagcctgggcgatagagcaagaccctgtctcaaaaacaaacaaaaaacagtccctggcactctgggccaggcctggcagggcagttggcagggctggtctttctctggcacttcatctcaccctccctcccttcctcttcttgcagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaataaggtctccattcatggattccaaggacaagaaagtcatatagaatgtctattttttaagttctttcccacgcacccttagataatttagctcagaacaggaaatgatagtattaataaaagctggacatcaggattaacagctctctctggggccctgaaggtgagagttctcagacttgctcatttgcagttgcttctttgtgatgctggcaaaccatcctagtcccattcaaagggcaatacaaagccttgtggctgacctcacgatgcagcactcagtttgcaagaccggcaccagtgtatgcaaacctgagaaggttggggatgaggatatgggatctttcatccctggaaatttagtccagaggcctggggctggagcagaacaccaagccaatcagcttaatgaatggcttagattcctgctaggtttgcagagctgccttctttcctttggtaccttattatagattgaggagtatttctgctaaaccaagatagggataaccagatagcatcttcatagcaatgccacaaaggaaaacaaaaacaaaacagtaatccatcatattattccttagtaactatgccaaggtcatgatactgaatccttagattgtttcaaaatactacttttctttgctcttcctgatgtgtttgccaccgcaggcagatgtttaagtaaaacagattttaactgcagctacaaaagcagcaacaggccagcaaaagagaagtgctatctcagagagcatggctttcagagccacaagagacagcctcactggctgtttcagcttgactgccatgcaaagaagagagcagagggagaaccagccccacccacttattcatcttgtacaaaaaaaaagcacctaccagcctaggctacatagtgagacactatctccacaaaaaacccacgaaaactagctgggtatggtggcacatgcctacagtcccagctactggtaaggctgtggtgggaggatctcttgaggccaggaaggagatccaggctgcagtgagccaagattgcaccactgcactccagtctggacaatcgagcaagatcccatctcaaacaataaaaaaaaaaagcgtgtaacctcctcagaagaaagatgttataatctcaggcagca

SEQ ID NO: 2 - DNA, 6816 bp, Homo sapiens
  CDS (323)..(2653)
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctgcgactaagcaagtccagagaagaccaccccctgcagggcccagatctgagagaggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 3 - DNA, 5544 bp, Homo sapiens
  CDS (323)..(1381)
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 4 - DNA, 137001 bp, Homo sapiens
caaaaattagccgggagtggtggcatatgcctgtaatcccagtagctgggaggctgagacaggaaaatcgcttgaacccgggaaacaggttgcagtgagccgagatcgtgccactgcactccagcctgggcaacagagcgagactccatctcaaaaaaacaaaacaaacacacacaaaaaaccaaaaataaataaataaaatgatcacttctgaatactgatctaactaggggttgcagggtgggctgatatagggagaaactggagagcaaggagatcactaaggtccctacatgtccagaaccaagatagaggtcttgaactaggatggtggcagttagaacaacaacaacaaaaagtcaattccaggctgagtgcagtggctcatgcttgtaatcccaacgctttgggaggctgaggtgggagttagaaagcagcctgggcaacactgcaagacctcctctctaaaaaaaaaaaaaaaaaaaagttagccaggtgtggtggtgcccacctgtagtcccagcaactcagaaggctgaggtgggaagattgcttgagccccaggagttcaagcttgccgtgagctacgattgtgccactgcactccagcctgagcaagaccttgtctccaaaaaaaggtcaattccactgacttttctaaggtgtacaccatcaaggggcagctccatctccaggccattggctcatgagacattctgtagtcagaaggctagggcagattgctttgagcaagcccccatggtggttctcactcctacttctttgggtatatgcccctctgtttaaaaataaagttaatatgcatttaaaaaaaaaaaggagaaaaaggtcagttccagaaactgtgtgaataaagcattttacttgctttttctattaatctataacatatgttgattttttaaaaagaatataagagctatgcaaattggagcttcaagacaacttcccatctccctaggaggagatggctgccctaaacccccctacatagaaatcatcccactgcttgggcttaaacttgatgttggggaaatgaaaaatccaagctaaggccgaagcctggggcctgggcgaccagcagaatgaggaccactggtcagtttcaggctgaggtgcgtcttccaggggacaatctctagctggcccttaaacattcagacttcaagctctatttacagcataaaggtgtttcaaaagacgtgatacaaataactgcaaatgctctgcgatgtgttaagcactgtttgaaattcgtctaatttaagatttttttttctgacgtaacggttagattcacgtttctttttttttaagtacagttctactgtattgtaactgagttagcttgctttaagccgatttgttaaggaaaggattcaccttggtcagtaacaaaaaaggtgggaaaaaagcaaggagaaaggaagcagcctgggggaaagagaccttagccaggggggcggtttcgggactacgaagggtcggggcggacggactcgagggccggccacgtggaaggccgctcaggacttctgtaggagaggacaccgccccaggctgactgaaagtaaagggcagcggacccagcggcggagccactggccttgccccgaccccgcatggcccgaaggaggacacccacccccacaacgacacaaagactccaactacaggaggtggagaaagcgcgtgcgccacggaacgcgcgtgcgcgctgcggtcagcgccgcggcctgaggcgtagcgggagggggaccgcgaaagggcagcgccgagaggaacgagccgggagacgccggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtaagcgccgcggctccgaaatctgcctcgccgtccgcctctgtgcacccctgcgccgccgcccctcgccctccctctccgcagactggggcttcgtgcgccgggcatcggtcggggccaccgcagggcccctccctgcctcccctgctcgggggctggggccagggcggcctggaaagggacctgagcaagggatgcacgcacgcgtgagtgcgcgcgtgtgtgtgtgctggagggtcttcaccaccagattcgcgcagaccccaggtggaggctgtgccggcagggtggggcgcggcggcggtgacttgggggagggggctgcccttcactctcgactgcagccttttgccgcaatgggcgtgtgtgtgtgtgtgtgtgtgtgtgtgtgtgtgtgtgtgtgtgtggaggggtccgataacgacccccgaaaccgaatctgaaatccgctgtccctgccgctgttcgccatcagctctaagaaagacgtggatcgggttctagaaaagatgactccctgcacgcccctccctgcacctcccgagcagtgattccgacagggccttcactgcccctgattttaggcgggggccggccccctccccttttcctccttcagaaacccgtaggggacatttgggggctgggagaaatcgaggagatggggaggggtccacgcgctgtcactttagttgcccttccccctgcgcacgcctggcacagagacgcgagcagcgccgtgcctgagaacagtgcgcggatcccactgtgcacgctcgcaaaggcagggttcacctggcctggcgatgtggacggactcggcggccgctggtccccgttcgcgggcacgcacagccgcagccacgcacggatgggcgcggggctgcaggtgcatctcggggcggatttctttctcagcgctcggagcgcagggcgcccggcgtgtgcgctccctgccggaggcgcggggctggcgcgcagggctcgcccctcactgcggcagtgggtgtggaccctggtgggcgaggaagggggaggataggctgtgcctcctcccactcccgcccccagcccccctttttttccccctcggaacgcgaggtgccatcttttttcggcgtgtcacgtctttacggtgccatgccaaaccgggtggccgggcttcataggacagggcggggcctggcattaaagggagggggacaatcagcgctgaaatcttggcgttttgctgctgcgggcgtgagcactgggggcgttcgcccagcaccttcttcgggggctctttgctttgtctgtagaggttacgtgatctgcgctcccagccctggtttctggcttttattctgagggtgttcagtcaacctcccccctacgcccatgcgcctctctttcctttttcgctcctcatttccgagcccattgttggatctcgaggcttgctgggttcgatgaactcgagtcaaccccccgacccccggcacgcatggaacgggcgtgaccgcgcgcagcctcgtctcggagtctgccggcgccgggaagcttctgaagggatgggattcgagtctccgtgcgcgctgcgggcggcggcagagggatctcgcccctccctacaccccaagtgtcctgagggccacgccacaccaggttgcccagcgagggacgctggctacccatccggggatgggtggggagccctggcggggcctctccggctttacgccctgttgcttcgcctggccggagaatgtgaggaaggggcataaggttactggtgcttcggccacacccatctttctgagcccactggactgggcgcagaggggggattgccatggaaaccacaggtgtccggagaggggatcttggggctggcctcaccccttccctgcggagattggggaccctggggtagggggagccgcgcccagtcggcctcctggaggacacgggaggaagccccgaacccccgcgcctgaggctgtttctgattggcccctggaggccgcagacacgcagataggcggccctgggtgtatttttattaatattatgtccgtactgattaatattatttatcttaaataaatttcacccgtgtccaagttcaccgcgcccccaaaaccgagtctggggcggcagggggaactcctggccaacgaatccatgcctcgccctcctgtgatgaacctggtacgcacggttttctggttaattctatcgctgaaaactggtgcggggggcgcacttctgagacggaagagcatctaggagctgaatcctccacgcgggtcgcccaggttgatctgaatttctggggaatggcttggctgcccgcccgggaccaggccgaccctccttgacggtggcgtagagggctggagcctgggtactgcgaggctcctcgcatggctgggcccgccgcgaggggttgcagagcggctcagggatcgattcaagcatcgtctctcctccctcgcccccagacagagctgggcgcggggttccccttccagatggagcgagggtctcggggtggccccggaaaaggggagcccgcggccacggctacgtattgccatctcgcgagcagagatgtcacctcctgcctttggaggaaagggagcccggtggggatgagcgcatttagcccaatgctgggaacaaagcgcactccgcgcttctgcgatttcgctccattttgaaatgtgttggcgctttggtggggccgctgcggtgggcaaggccgggggcgctgttaatggaggaacctcagggggacggtccttcgtaggaaactctatcctggctctgcgcgcgctttaaggaaatggcttccctccaggacctcgagggatgcagcttttgcgcggatgacggtggggtgctgaaccagccggtgcgcctctggaaatgtctgggcacggatcctggggccatcgacgactcctccccattcccagcaggcgggagctcttacattccgagcgagtgacccctctcaccctctggcgctcacacacctgtaactccaaacctccgtctcagaatggtccaggctggaagggatgatgggggctccgacagcgactgcctagctcacccctctgcgtgctcaggctccaggctcagcaggaccaatttgagttctatctgatccccctcggccccttaactgacccatcctacaggagacagggaaatgtctttcctaccgcggttgattctggggtgtcattttgtgttttgtgatggctgcttatatttactgtataagcattgtatttactgtataagcattgtattataattactgtataagctgcttatatttactgtataagcatctccaaatcctccctctacgtaaacaaattaatggataaacagataagtgtatcccctgcccccacccctgctacgcaggtccggagtgactcttgaagctcatacattccttggccaagtttgcttctctaacagatgtttatatagcaataacctggcttggctcttgggttcacctttggacgatttggggaaggggcttgttggctttgctgggttttggatgagtgacagtccatgactgttcctgctggaagggcgtgacttttaagtggtttctaatatcaggcattgctcctccgacaggaacaaaagaaatggatactgcccataaattgttagaaaacttagaatcgctttgattgaggaaaggttagatttattccggttggaaaaagtggcctttctattaaacgtgccctttgaccctcatgcccttggaggtcggtgccagcctggagatgggataagattgtggttttccttctgcctttttaacatctgttgttacagtccatttgttgaaaatttaaagaaactgttttattccactttccctcagcatttatgtgtgtggtttcagtagctctgtggctatatgtacgaacacgtgttatttttccaattggacatgtgataattttccaactggaccttgccttctattgatgtatttatttagcatcttccttactccctccttgaaaaagaatcactcaaaaacaaataaaaacagccgtaggggcctaatacagtgctagacatacaagaggtattcggtccataccaaatggattttatccatgaaggataaatggggaaatacagtgggaagcaggtgggaaactgcgtttgactctgctctttcctccaccaccactttcctcatcaccgtgttcagagacccccaaagccccctcacactcccagaaacacccccctggccactcctaacttgccatgcccaggagttaggtgcttccactagtgacatggagctggcgtttggggggcacctcagcaggtgacgggaagagaagaccccagcctcaccagctgggctgcagcagggagaggagtcctcatgttccagcagggactctcagctgttttcctgtaaaaccatggttctcaactgggggccactgagatgtctagagagatgtttttgttttcacaactcggggagggtgctactgacatcttgtgggtagaggccaggaatgctgttaaacatcctacaaggaaggcacaggacagtctcctacatcaaaatatgacccagtcccaatgtcaccactgctggggttgacactggcactgctatcttaattacattcattgagtgtcttttaggaggccctattctaagtgcttgctaagattatctcatttaatcctcacaacacttccgctatgtagcaggtgctgttattatctccgtgatggggaaactgaagcacagagagggttagtaacttgctaaaggtcacagagccagtgggtggtggagctggttgcctgacactagttccctcccctctcagccacatgtgggtttacttggccattgtggactagtctgggaacccagatatgatctataacattgacccagtagaatattgattccaaaaccactgtctcacaaatgaatttttacaagagtctgtaatcggagcatgacccagaataaggttagggagatgtggagttaaagctctcaatttcttatctggccccgacacagagagcaaggcatttcactctacattggtgctctgtttataaaacaaagagcaaatatctcttcctaaggtccttaaacctcttcccccaatccagggtttctggactgctctgccatatgacggggcagctggtttgattgacccagggaaggctggaaatcaagactgggggatcaagacgtagattcagtgtggccaaggtcaagtctctgaggtttagggacatcagatccccagcttaggttctgtacctcggcaaggtgaaagcgttggcgcccactgatgaggcctgctctgagattgtgggtgtgggttgagttgggtgggcataggcaagtcctcttgtaagaatcttttggcaaagatgggcctgggaggcttttctcacttcctggggcccaggctttgcaataagtattccattatactgtggtaccttggggctacctgagaatcctctgtctcgcccctgttgccttgccaaagagtttgctgtccaagaattcctttcctgtctccaggtgccatgctcctgccacctctgccaggttccctgcctgcccagatggctcccaactgagtgtgaggaggaatttgagacaggttttgagctttctgggttctccagttaggaaactttctgtaagcatgcagatagaatgggcttcagcaaaatacaaactcgaacaacttccatgtatagtcccttaattttctttgcttttttcatatttcatcaggctccatgctgagcccaatcagggacccgatagaaatccaaacaccatgtcagcgagtccccaagaaatgcattttgtgccaaggctattcaaggaaggtttgggagcagctcaagggcagacactgttaccctcccccaggtccccagtgcagggcagtgttctgcatgtggaggcagtttggcctaatggttaaggaggtaggctctgatcgggcctcctgggcacaaatcccagctccctgctcactgtgagacctaagccatattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgtcctgtggatgagtgcttgtgattggctgaatgaccagaggggtctaaagatcctggtgatggaatcagttgtacagataaattgttacactgagtagggatcaagataggaaaagtcggcaactacccagctcccctgcaccaaactgggcagaagtggatcctctgaaaattgcacacacccatgtttaaatgtacacacagaactcttgccacaggcaagcggagatttgtcatctgctgtccctgcctcatcttcttcctgaaatccactccatgccaggaataaactgcatgctctccaccagcccaaactgacctgccttcccgccagccatcccgggcagggtgacctggcttagtacatcgggttcagagatctttccagtttactcgttgaataaaaagtgagggctgatcgagaaagtaatggcagtcagggaaggcgaaggaggtaaagaagagattttacaaatgaagtaattcaacagagtgctgacattggtaaactggcaaacagatttcagggtggttggttgagagtagagtagaaaaggattaaataaagcaaacttgtggtgtactgaatcttaggaattccatgtatccaataagtatagtcatttatgaattaataaattcggcctaagaagccttcttatcgcttaaatcaagactaagtaacaatatatcagttttaaaaagtcattatatcagaaaatcatttaaatgatacacatagatttccaagattttactttaaccgaaactatataaatgtgaatttgttcacccatcttttgacacagggctcaggtcttctcttggtgtctggatcagccagttgaaatttcttgtctgttttgcctatgccacattaataatgcactgtctgggtcctccgatttcagtttggattttgggtttacattgtggagtcatctgaatgcagaatccttcagggattttacttttttttttttttttcatggtctttaccatcccatttgatagtaaatattactcacctttatgaagtctttccaaaacattcaactaaattttcttaaaatcattgaatgatttgaagagcttattcctcagcacttttactccatcagcttgcaccttattttttaatctttttttgagacggagtctcgctctatcgcccaggcttaagtgcaatggcgcgatcttggctcactgcgacctccacctcctgggttcaagcaattccgcctcagcctccgccgtagccgggactacaggtacacaccataatgctcggctgatttttgtatttttgtagggatggggtatcgccatgttggccaggctggtcccgaacttctgacccaagtgatccacccacctcggcctcccaaagtgctgggattacaggtgtgagccaccgcgcccggccagcttgcaccttatttaggatatgtgattattatagcaagtctggtgtacatacaagattttgaatgggcacagatgacctttagtaagtgcttggctgtgataagaggcagtcctgactgcagatcaggctgtgtggaccccagccttgcatgtttacagaccttcatgtcttattcttacagggtatcagaagaacacctactggggaaacttataaattagtaaaaggtgggcattctccccgcccatcttctgtctgtctgccaggactagcacagcactttgaagtcattcacatagaatcccaacttaagagggtaaaatcctcctcaacagactgaaaataagtttaaattccctttgctatattaactcccctgaggaaagagtcttagatcaatgtccaacactaaaaacagttttaaatcagcaagtgagaattaaatctgaagcaattgataataatgtttcattcattcctctcctttggccccgtccaccctactgctaaatccaggcatcaaagagaagagggacataattatctctagtcccagctgctggttttccttccagcctatggcccagttttctgttttactgagaaggctggtgatgttatcttgggatctaagtctgcagtttcaccacaaaaagtccagggatgcactttcatgcttgtgtcctcctccctgggatagcaaggatattagaagacccctggctctgtaattgcttgtcatgtgctctacagacgccacagaatgccaagaacgaagtgctgggaaggacaaattcatggaaccgtgggacggtgctcctcccccagcgtaaaggacagctcctcctcctgaattggagccagcgttctaaatcatgtgtcaacagagttgtcctggatcggatccagttctgccattgatttgcaggtcatttcagtggtacctgtttccagttgttcttaattgaacagtggcaccaaactattgtcttgcctcatccccctcccatggcctgtcccccaaaaagagacttcttgggtaattaatcagggcaacatcaggcagtctgggcgcggtggctcacgcctgtaatcccagcactttgggaggccgaggcgggcagatcatgaggttaggagattgagaccatcctggctttgtgaaaccccgtctctactaaaaatacaaaaaattagccgggcgtggtggcgggcgcctgtagtcccagctactcgagaggctgaggcaggggaatggcgtgaacccgggaggtggaggttgcagtgagccgagatcgcaccactgcactctagcctgggcgacagagctagacttcttctcaaaaaaaaaaaaaaaaaggaatctctttggttttatatatttttttttatatatataatatatattaaaatataatatatatatttatataatataatatataaatatattatatattatatatttttatatattatatattatatatattatatattatatatttatatatttatatattatatatatttatatattatatatttatatatattatatatttatatataatatatattatatattatatattatatattatatattatatatttatatatattatatattatatatattatatattatatatttatatattatatatttatatatattatatattatatattatatatttatatattatatatttatatattatatatatttatatatattatatattatatattatatatgtatatattatatatgttatatattatatatatttatatatataatatattgtatatattatatatctaatatattatatatattatatatattatatattataatatatattatatattatatatatttttatatatataatatgtataatatataatatatataaaaacatatataatatatattatatattatatatatattatatatattatatatattaaatatattttatatatattatatatattatatatattaaatatattttatatatattatatatatatacacatatatatatataaatgaggccaggctcggtggctcacacttgtaatcccagcactgtgggaggatcacttgaagccaggagtctgagactagcctgggcaacaaaacaagatcctgtctctacaaaaggaaactgtaaaaattagctgggcatgatggcatgtgtctgtagccctagctacttgggaggccgaagcaggaggatcgcttgagcccaggagttcaaggctacagtgagctatgattgtcccatagcactccagcctgggtaacacagcaaggccctgtctctaaactttttttttttaattctatttatatttacatgtatttaaatgtgaatattcactacctatttgttgcatgcctgcattttttatactgggcttgccaaaaacccgaacagctttctactttgacaatgtatcagaatttaaatcagcaatatgttaataagccaagcaaaggttatatatgcaaataaaactgttgtctataacctcctgttacactggggcacagcaaaagtcatggtgtagtcgcatgtgaacctgtccctttcatagctgctcattgccaggaaacatcaggaatagccatttggaagagtcatcagccctcccaccatccgttttctgtcttgtcttttccctatgagcaggggaaattccacgctggccccaatccccagtgcagcggctcagcctctgcctctgctgctggtccccatgaggccagcttagaaacggaggattttgcagaacatccctaaatccgcttgaataatgaagtgatcattcataaactcacctgaaccttattaaaacctatttaatatttttcctggataatcctatagggataacttgcctcctgggcttctctccaccgggttcagttcttcctttagtggtgaagttcctcccttcttagcatctcaactgtgcctgagaaaaggccagtggcggctgcactctgttccctgtggagtgttaataaagactgaataaattgaaataaatccctttcaatgtcattaagtgctataaataatcatgaaccaatgttcgatggctgatgagaaatgcaagaaaaaatttttaatcagtaggattcataagttgacaatctgggccaagttaaaaaaaataaaaataaaaagacttttaaaaagatcttatcgtttgttaccagtaagactgaattccagaagcaagctactccctcatttgtgggcccctgttatcactggctgcttagggttgccaagccctgaattcatttgtcaactaagagatttttggccaagattaagatttcccatgcctccatatttccatctgagaaatggagattatactgtcttccccctcagaatggatgataatgtggtctctcttctgttcgcatagtcatagaactgaaataaaacaacttaagagaattcctttgagcttctcagaagtgctgcagggctgggggatgcctcccaggagccgcagtcaggtgctgatctgaagtctttggtgggctgactttagcctgacctgaaatagtatagctgctgccacctggctcccttagcgtcagtcagacggtgcagctggttcctaggggtgagggctgagccagcagggtccgtgcccaggagggatgcatgggtggccacagcccagcctgcactgatcttgtctgtccccttctttggaaggaaggagccccaaaccagggtgcaagacagtgggtgggggtgccttgagcatgacctcaagtgatttccagcccctgccagtgctgacttctctggggaagggctgggacttccttctgggctcaagtcacgacccttggatggaatttcctgggagcttttctgttttttctggagttttcagttttttcctaaccagacagggacttggtacagaatctcatattctaattatgcctaggagcagcctctccccaccactcacagtgtttagcatgtgacaggaatcgattaaggcatgagtgattaaattaaagccaggcattgacttggatggtgtaatattctgacatctgtttggtgtcaaaggcacggggcaggcgcgttaattgaactgcttgcacctggcatttgaattgagccagagcggggctaaagtcagtttgccttcaccctgtaaatggagggtttctccggagcgtggatggtgggaggtatttcagggtgtatgcataacccccaccctgacaatggcccatctcttctccagcgtggccaggtttgagtgccagtcctgggtgtccagtggccccatagccttgcgttttagtaaaatgctgcccccattaccacctggtctgtgcacttcggtcactggaatttgccatcttccagtcccgaatgtggcaagccatggagccttaagctcttctccctccacatcctggaacagacccgccagtttcttccaggcattgcctcagtttgcccctctgtttccagtcacactctcaccagcgataaaatgattttagaccttatcatctcaccctcggatccttatggaaacaataatgagttgttccctgtttcaattccaaaattcatatccaatccgttttgcatgccattgccaaattcctcccagagcaaccccgtcacctgccctggccctctccaagtgtggtcctgccatgggcatcgcctgctaagccaagctggcctcgagctgcctgcccgggtccccacaccttggctcacctccctgcccagtcccgcctcctgccagcctgccctgtggctccttcatagatgccgtgctctttctgccccttgctcacccatggcagccttgcccctctctccctgccccaccccctatttaaattgacctgaccttcctcagtgtccatcttccccgaagctttccccagccttggcactcaaggtccagaggctacgcgtttcctctcacctgtggcagcgccgtgctccccagtgcctcacagtttccttcttgcccccgcttcctgtgtaggactcatctgcccacaggttgcacgtcctgtgagggcaaggactgtgtcttatgtgactttccttctccagtcacagagctgggcacatagatagctcaaaaccctctttattaacacagttggatgttgagaaatcaaacaggccaatgtcaaatgagctctccttatttaaatcaagtcagttctccacctcctagcactcagttccagtactctatatacatggaaataataaaaaacacatttcctttgaaacattctataatcgttcctttgccctacttcagaccaacttaacgcactccccattggtccaaatgagttttgctatacgaagatgctgataataatagcagcagtggattattctgctaaaaccattgcctcgttaatcctcagtcccgaggtggggattattatcctcattttgcagagaagcaaactgagactcagagatttcacagctggggagggagccagctcatccctctgtccaggcccaagctctctcccgcttgccttcctgcctctgcaacctcagagcatcccccatctggttctactgcctgtgctagtcgtgcaggagccaaaagacacgtctttagtgctaaggactggagaagccatgccctccagcctctgtgaatgggtcatatgtaacatgagcctggagaaattatttgaaaccaaaggcaagcctctaaaccaggctgctgcttcatggcgccggtgacggcagaaccaaatttagtgctgtgggcaggtccacacttatcaaatagagaagctcatttttcttccggctcacatcaagcatgaaaaatgttcacacataccccccacacacacatgctttccggaggggtccatgtggctagaggctggaagatgtggatgagaggagcctggcaggtaagcccagggaagatgacattcagcttcccagacagcatctacagggagaaatttaattaaaagtggggcggtttccctgagcaaggcagacaaagtcagccctctactgttaagaaaaagggtcacagtgagaggggaggtgaggagactgagtctgtattttctagtctgttgggctacactacctgatcccccttcctcaaaaatccactttactttccccatgtctacaccaatgtggttcacactctgggaccaggaaaagggggagtgatggggaacagagaagggaggagctcacacagctgaggctggggttatgcatatcgaattacttagaatttgcaacctcacagggtactttcatggcgttgaaatacacttcccacagccaccctccctctaactaaaagcaagagtcatttctcagttctggtcttgcctcccacgttctcctccacatttaagaaaatccaccagctacaaagtgaagataccatatgtgatatcccaccctagtttctgttttatcagggtttggagcaggtggagcaggcagagggatcatttcagcctataaattgtattaagggtgagtactgagtcattcttcaagaaaagttttagaagcatccaaaactgaagggtggagccacctggagacagtatcatcagtcctggccccgagcatggcctgcataggcccccatggatcccagcgggagctgcagagtgcgggcaccttggcacacagccctgagtgcaaaattaggagctgggcagagggcatctctctgtcgccattgggcagcccagggcacactggtcatagccttagaccacgaacaccctgtgcccgggggacagatgcaaccagtgtgccctgggctgcccaatggcaacagagagatcgacacctggaccccatgtcacggggactccactactaaggctcctaagactgccaccttccagtgggataagccctgcctcctactgggcccacaatgtgcagagaacacttgggactacctggctttctggatacacaaatattgatccaatctggactaattagaaggtcagtcccaataacaaatcgaagtcagctgggcgtgatggctcactcctataatcccagcactttgggaggctgaggtgggcagatcatttgaagccagaagttcaagaccagcctgggcaacatagcaaaaccctgtctctactaaaaatacaaataattaggctgggtgtggtggctcatgcctgtaatcccaacagtttgggaggctgaggcaggtggtcacctgaggtcaggagtttgagaccagcctggccaacagggtgaaaccccgtgtctactaaaaacataaaaattagccaagcatgatggcatgtgcctataatcctggctactagggaggctgagacaggagagaatcgcttgaatccaggaggtggttgcagtgagctgagatggtgccactgcactccagcctggttgacagagcaagactctgtctcaaaaaaaaaaaaaaaaaaaaaaaaagccatgcctggtggagcactacgtgtaatctcagctatttgggaggctgaggcacgagaatcacttgaacctgggaggcagtggttgcagtgagctgagatcgcgccactgcactccagcctgggcgacagagtgagtgagactccatttcaaaaaaataataaatctgagtcactttaatattgttatttggatgtcaacctctaggtgtttgagacaggagagtgatatgggggcactggaaacacacaggcacggggtgtcctcacacttgggtagcccacacgatgtgatttcagggtgctgggaggtccccccactccccaaattactaacaagtggatagtactttacagtttatatgatctcatttgattcttaacatgagcctgtgagtgaaaaattccttcccctcttctacagattaggacgttgagattcagggaggttcagagggattcagggaagtcaagtggcacctggagtcccgtggctaatttgaggccggtaggggattcgaacccaggatttgtgcttcttatgcctgggcttctgctccctggggcatggtcttccccctagctttcccattcactgctttagcctaggggtcctaccctttattaaactgccagtgcctcactgcttttctcccccaaagacaaaaaaaaagtgtttttgcttttgttttgtttttcatgggcagagacctggaatttcagcttgagaatttgtgccatatgataaataaatcaacagatggctttttccttaaaaaaaaaaaaaaaaaaaactaagatgtatttgcagtgaggcataatttgtaccaaaaagtgctcaccacactgtagtcatgggggcaggaggcagccgcgggtgaagggagaaatcttggagtccaggcagcccccttctgggctgaactggggagctgggggtgctgccagccctgccaggttctcctaggaggcggcagctcatatggctgtgggaggaggcagagggagcctcatatgcacccacatttccagggatctagaagacagaaggaggaaaaccaccatcatgttaaagcagacagttaggtaacacatcctgtaatacaagttattttttccacatctaaaggctaaaaatagttgttagaatttaaagataattggtaaatgagtttctatccttctagtttcacatcaaatggaatcatgctgccttcacatcactagtgcccgttatttgtgtttaatttccacaatgttgtctaattccactctttgggcttccccagggatccagcctccctcactcgcccatcgcagggagatgctttattcatctttgtgtcttctgtgccgggcatagcgcatggcacagaataagcactcagtaattgattcacgagtgaataaatggatgagtgggtgagttcaatattgactacaaaaaccctaaggccacactggtgagtggctgcgcctgtagtcccagctgctggggaatctgaggcaggaggatctcttgagcccaggagtttgaaactagcctgggcgatatagcgagaacctgtctcaaatgacaaaaacagggccaggtgcagtggctcacgcctggaatcccagcactttaggaggccaagatgggaggatcacttgaggccaggagtccgagaccagcctgggcaacatagggagaccctgtctctacaaaaaattttttaaaaattagctgggcatggcggtgtgcgcttgtagtcccagctactcaggaggctgaggcaggaggatcacttgagcccaggaaattgaggctgcagcgagccatgatggcaccactgcactgcagcctgggcgtcagaacgagacctgctctcaaaaaaacaaacaaacaacaaaaaaaaaggctttcttaaagagacttgagaacagaaaggggaacagatacataacttatatatttatttgttcatctttccaccttcctggagggtggaggggaacaggtctgtatttggagttttgaatgctaaaagtgggaatacatgtactgtttgccatgatctgttcaaaagttaagccaaatgccttagattctcctgaaaactggaatgccactgtaaactataagccccacttcaaagataaaagatcttgatgaacagggctgggtctgtggactgggcctctccccaccacacaaggaagggtggtgccagttgaaggaaaatcacttaaatccttgctgtctcctaataaggtgtggtcccaggtagggctgtcagaattagcaaattaaaacacagggcatctgtgaaaattagaatttcagataacaacaaataattggcataggctgcataatgtccctcaaagatatcaggtcctaatctccagaacctgtaaatgtgatcttatttggaaaaggggtctttgtagatgtggttaaattaaggattttgagatggggggattatcctgtattatctaggtaggtcctaaatgcagtcacactcatccttgtaagaggaaggaagagagagatggaaaacacagaagagaagacaatgtggtgatggaggcagagattggagtgaggtggccacaagccaaggactgctggcagctaccagcagccagaaaagtccaggaaccaattctctcttggagctccagagggagtgtggccctgctgacaccttagcttcaacctagtgatcctgattttggactttggccttcagaagtgtgagggaatgaatatctgttgttttaagccaccaagtttatggtcatttcctacagcagccacaggaatcaaaaacagtaagtatgtcccatgcaatgtttgtgacacacaccaaaaatattacttgttgttcacctgaaattcaaatttaactgggtctcctgtattttatttggccaacctagttcccaggcccaaagaaagaggcttttgaaatttgcaagaaagctggttggagctgtcagaaagtggactttgtaaacacagtaccaccgaaccaatttgaactgtactacctctagacaaaagagagggcagtcagacagttgttcgtgatttcttctttcaacagtcatttgagcacttactacaaaacagaagctatgtgtaagggtggaggcgttagctgttaatcaggacctccaggctaagtttctgtattagtccgttttcacgctgctgataaagacatacccgagactggggaatttacaaaagaaagaggtttaattggacttacagttccaagtggctggggaagcctcacaatcatggcagaaggcaaggaggagcaagccacatcttacatggatggcagcagacagacagggagagagagcttgtgcaggggaactcctctttttaaaaccatcagatctcgttagacttattcactatcaagagaacagcacagaaaagacctgcccccatgattcagttacttcccaccagatccctcccacaacatgtgggaattcaagatgagatttgttaccatatcagttaccaacccttccagataaatcacgtgaaatatcgccattaacagagtgagctcaggtggttcttcagtgcatttctgatacctgaaccttccctgggaatttcacagaccatcaggctctccaccctttgatagcaggatagcagggcccaggttctgcaggaggagatgttaccacaggcctgaaagggagggaggggcagatgctacaggaagatgctggctctggattcgctggaggagctttcaagggaagtagatacacactgtctccatcatttcatgtccatcacactctaaaatgctttggacaagaagcaaatgttaaagacaaatgtggcccattttcctgtacaaagagggctgctcccatgccaggctattggcactggtgggcatgaggcttctctgctgccctggccggggggttctctcactcaccattggctctctgacacctggagagaccaccacccttgggctttcatgatgctcacagaatccacactgttggagctttaaggagcctggatcaactggaacaggcagggagtactaggacagcccagcattgccccaaaatatccaggcctgataaaagagaaaaacaggtagctcacaggaaaaggataaaaaaaggaggagggatttaacatgaaaaggtgcttgatctccctcataataaaaagactgctgattccatccaggcaagtgacagaaaaaaaaaatttaatttaaaaagactgctgataaaaccacagcgagacactgctgctcagggatctgagggtgtgggcagccaggctgccacgcatcatgggtcggagaggaagaccacacccctggagcagagggcggctgatctgtcagatgccctttgacagcacctcagcttccaagaattaaccctttctatgtgagcagaggcatccatggggggacacactggtgaatcatctgttatgtagaagtctggaaaacatcaggatggaactggtgaaataagtgtggcctctgacggaatggagcggtccgtctgcactgctgcgggtgcccctcagatcctgtgggtcagtgagaaaagcagtgaggaacaaggcaggtactgtgtactgtcctctgcgtgcaaggaaggccagcgcatgcaacagagtccacacagacatagcctaactctggaaggaagaatgagaatgcagtttcagtggtggcctctggtggggagaaactgggtgaagggagatgtcatttccatttctctactattaattttgtattaccatgcttaaatgttactttttacctttttttttttttttgagacagggtctctctctgttgcccaggcaggagtgcagtggtacaatcatggttcactgcagcctgaacctcccaggctcaagcaatcctcccacctcagcctcctgagtagctgggactataggcacgcataccaccgtgcccagctattttttttaatcaagatggagtttttctatgttgcccaggctggtctcaagctcctggactcaagcaatcctcctgcctcagcctcccaaagggctgagattaaaacgtgagtcaccctgcccagccaattgctttttaaaaaagattaaatgcatgtatacgctcaggcatcagcacacttggaaaggatgaaaatatccggaagaagggttcttttaaaaggctcctcaagtgatgctggcaggcatgacgaatgtccctggtcacaaaagctctgatctggcctaaccctgtcatgttagagactggagtgcgtgtgtgtgcgcgcaaagtgtggggggatgggggtgagtgtgtgtggtgtgtaagcatgagtgtgtatgtgtgtggtgtgggggtgtgtgctgtgtgagcgtgtgtgagtctgtgtgtgtagtgtgtgtgtgaagtatgtggtgtgtatgtgtgacgtgaggtgtgtgtggtgtgtgagttgtgtatggtgtgtgcatgagcatgtgtgtgggcatgtgatgtgtgtgtggtgtgtaagcatgtgtgagtgtgtatgtttgagcatgtgtggtgtgttgtgatatgtgtgtggtgtgtgagcatgtgtgtgtgatgtgtctgtgtgtggtgtgtgtgagcatgtgtgttgtgtgtgtggtgcatgtgtgtggcgtgtgagcgtgtgtgtgcattgtgtctgtgagcatgtgtgagtgtgtgtgtgttcagcatatataaggcatgtaactgaacacagcactttagagggctctcctggagtcagagggggtgggtaggaggagaagggaggtgggctagtgtgctgaagtatctactccttgtcatagtctgtgacaacccagactagcccatgagccaccctgttccctgcatttccaatgagacctcggtggacatgttccctgaggtgaggctgactgatgtcatttgacgatcttgatgccaaatccttttatatcaaaaacaaccagaacactctcttttctcttagtgctttcacccagatgaccacatttcatcctcccagccactctgggccaggtggcactgctggtttgaaagggaggtctcccctggagtaacttccgtgggcggattcacaccctgcccacagtcctgtcccagtcagcccaccatggtggtctccggttcctccagaattcccgcttttcagctcatccccacattcccggagggactgagagcgcagccccagggccctgctctttgggggccgtctctacacccagagaagcagcaaggcattcctaggtttctctttcagatgcagaacttcagtgttcagagatgttcccactggtcctgagagggctcagttcagctttaatgactgcgctgttgcgtgtgctctgcagagggcgggtggcccagcgtggctgactgcagttttcctgacgtggagcccgagcctgccccgctgtttattaattaaggatcactctgcttgcagaaccctgaactccccagaactgtgaggtgggagaaccccgagaggccacctggccccacttcccacctgctgcccaaaccccctctctgccttcctgacagtcaccccaactcccagtgatccccatcaaccatctgacaaggggactgagagggaagagaaaggaggggcccaaagaggaaggtaaaactgtcgggaacagcccccaaatgtgtgacagccttcagtggagttgcccactttcccttttctcctccctgcaggacctcccttctccccagtcctccccaacttctgaggttacattgagaaaagtctgcagagaggtgccagcatcacaaggtgttaaggaccacgagtttggcattttaacagatgccagagccacttgagaaatgtggtaactaagcccagagaggtacagttaacctccccagagtcacacagcaggttcatggcaaagctggactagcacaggtgtccttcccctgcagatccccttctgtgccccacatcacctccctccagtgtctgggccacctggagatgggccctcagactcacccggccagaggtgccatctcatgggagaggtctggccaggaagcatcgatatttgagatcccaagaaatgaagacttggcctgtcagatgacagacttcggtcatgggaacacgtgatctgttttacacatgcgtcccctcagcagcagctttccagaacattcccactttcttctgtagtgagaagaactctttccctgcagcctcctgcccaactcctccttcagtgtctttgcttcagtgtctttgataaaccattctgctttgcagagtgcgagctctgccttgcagggttcgcatctgcctgtgctgagtaaccaacgctaaggtcgagtggtcggtcacctctcataagagctagggttgtctcatgctgatgactaggacttgccctcaaggagaaaaataaatcaaaacaaaagcaaaaacagcaaacatgcatctcttaaagaaggctctgagtccaggtaaatttccttccactgaagcagccaggctgaattcgaattatctttgcccctgcttaaaaactaatgcaaattttcctagagaatatccactaattcctggagggggcatgggcattcctgatgcccatgagaggaccatttgctcttccctcagtatgctaaataacagaagcgacatttgttgctggaaagtatcagtgaagttaataaggtttttcttgcccagggtgagggaacagttcccaatgacaaatgctgtatgggaaggggctgtagaactgccagcccctttggtccatccgtaaagtgaactctgtggatcctggaggattccagcgtctttttttttttttctttttttttaagacagagccttgctgtcacccaggctggagtgcagtggcacgatctcagttcactgcaacctccgcctcccgggttcaagcgattctcatgtctcggcctcccgagcagcaagactacaggtgcgcaccaccatgcccgactaatttttgtattattagtagagacgggggtttcactctgttggccaggctggtctcaaactcctgacctcaggtgatccacccgcctcagcctcccaaagtgctgggattacaggcatgagccaccatgcccagccagcatctttcatttttctgtctgctttggccctttcctctctcactgtcttccttttccatttccaaagtcagtccatctcactattagcacaaaaactgctagagcgcttgtcattggtcatctctccctgcacctggctggtctgttcttggccactgaagcgtttcccccagctgttgctttaatcattttattgttattatgccttacttaagaaatggatatgagatgcatttacctgtctcttcctgccactctgcagagccagtaagatgtggtggaaagggcccaggctttggaggagggctggctggggttggatcttggctgccccctactagctgtgtgaccttgggtaagtagctggacctctctgagcctggttcggaatcatagcacctctctttcagggctgctgtaaggaatagcagtggtgtgtataaagcagagcgcacagccagcaactggcccctagccacactgctgagcacctactgtgataagctgccattgtggtgtgtgaagcaaaggggaaacatgcctgctgtagtgagcttcctgtagggcaggttgtagaaccagaggtgggttccaaggttacaaagggactcttagtgtattagtctgttctcacattactataaagacctacctgagactggatcatttataaagaaaagaggtttaattggctcacattggctgggtgcggtggctcacgcctgtaatcccagcattttgggaggccaaggccggcggatcacttgaggtcaggaatttgagaccagcctggccaacatggtgaaaccctgtctcttctaaaataaaatacaaaaattagctggccatggtggtgtgcgcctggaatcccagctactcaggaggctgaggtggaagaattgcttgagcccgggaggtggaggttgcagtgagccaagatcgccccactgcactctagcctgggcagcagactgagactctgtctcaataaaaaaaaaaaaaaagaaaagaaaaagaattgcaagaaataaattattgtttatgagctatatggtctgtggtaccttgttgtgggactgggagtcttggcgtctccctgaccctgcctgttgctgcagcaccgctcagccctgcctgctccctacctgcctcccctcggcctctcctgcctccaccgggcccctggtgcctcctctagagacagtcctcctgggaccgattgtgttctcacttacacgaggcatccaggactacagataaccagaggaaggggcgccccccccgcctgccctcctccctggcatcctcacgctgcagaggtcagagcctcatcccagccccttacctgcccctactctgtggagaaccgtggtcagttcgccaggccggatccacgaacggccttgtggaagatggtgagctcacacccagagctggctccgatgaccctgtctcctttacatgtttctaccttcccctccctaccttcccccactgctgggcgcagagtggaggcagatgaggtttaaagctcagaagggcttaaacgggttggggcgcagtggctcatgcctgtaatcccggcactttgggaggccaaggcagaggatcacttgagcccaggagttcgagaccaacctgagcaacatagtgagaccgcgtctctacaaaaaataaaataaataaaattagctttgcagggtggcatgcacctgcagtccctgctactcagaaggctgaggtgggaggatcgcttgtgcccaggagtttgaggctgcagtgagctatgctggcaccacagcactccagcctgagtaacagaatgagatcctgtctcaaaacaaacaaacaaacaaacaaaagaaggcttaaagggggctccaggtgggcttggcagcacaaagctatgaagttctatcttagacacaagttctgttactgggcctttgcaggctggcctgggtacctggctgccatagacagggaaccttccagatgagctgcaggcgtggagcacaggagccagggtgctcttcctgggctctgtccacaggcagaacgtacacagtctttgtacacgtccggcggctctggtgcctatttttgtttgtgtttttcttttgtttggggggatggatttggtttcccccgagccctctgtcctcctgtcacctggctggtgctcggcaatgttgaccagctgcctggctggagttggcagtggctaaggctgtgacagctaacatgttcctgagtcctctcatttcttcaccataatgccctgttgagtttgcagatactgtctctgtttttatctcccggggaaactgaggctcagagtggctaggccaccttcccatggtccctcagctcatgagggccacacagggcattgcggtggccttctcctcagccttgaccctccggccccagcattgctgcctcaaggggtctcctctgctgagccgtgcaccttctgcctggcagctccaactctgtggctgtgttcagtggctcagcactgccccttgaccctccctggccttctgcggatgccagactggagcactctgacaaggtctggggtggttgtatgggtcctgtgacctctatacacctcccagtgcctgggaatcctgcagatacaccctccttagccgtccctaaccatagaggacatttctgaggtccccgagagagtggggcacccctgcaggatccaactgctgggcccaggaaggatagcagcagcatgaggggttccattagccacaaactcacggcatggaaccttcacccacctcgcccctcatctgctgtttagcacctggcacgccgtgtatacttactgattattacattttaatggcaaattatagtggcaaacgtatgcatctttgcacaattgttgtacagcatgatgaacaagtcattaatagtaaagaataaatgtgaaagtgagaaaaatctgactgccaaagtttttactccttccttccctccccagacttttaaatgaaagtttagggataatcccttagttgtcctgctagtaggacttgcaattaaaagaattgggccaagaacacttctacgcttctccttttaggtttgggtgtaaattcggggtatttctcactgatgaaagcctggtgcagggcagaccgtgggaagctttcatttccggaatggaccatcaacatcccttggagaagaattctcttctccagacccagacctggtgtcctggcacccattgggcaagtgggtcctagaagacaaacctggtcagagcctggaggctgcttagcattccccacgcacattagcagctcggagagctcaggaagccgcagcccctccttgcctcaccagcctggatcaggacagcatcccctggaagacacacagggcctggcctctgattacccagcctggagggaaagctcaatcgagcatcatgtcacccggtgcccccatgcagggtggcactggtgagacccccaagccaatgataccacctcacaggagtgcaggcccattgtggccagatcatcttgacttttcaagataaatcagaaatcgtatttccatgagatatccctatttgcaagtgatggtgactaaattagaagtttttgaatattgtaacatgttcgtaggctgtttgtctggtttaaactctatctggaggaattcaagctagacttcaggaataacttcttgaggcaaggattttgagaccttagggaaagaaggacgtcttgggggtattctgactgttgtcctcctggaagggaagaacagagaactagaagactgcccttagcgaagttcaaagcacctaagcccgggaccctcagcaagtgttcttgagtcacagattctccctgaggcgcctctttctggctccatagaatggctgattctgtaactcggtgagtttgctttttttttttcctccatcacccaggctggagtgcagtgaagctggagtgccgtggagcgatcactgcaacctctgtctcccaggttcaagcaattctccttcctcagcctcccaagtagctgggattacaagcatgcagcaccacacctggctaatttttgtgtttttaatagagacggcccgaagtgctaggattacaggcatgagccaccgcggccagccataactctgtgactcttgttacaaaggccttatattttgctctttgagggtggttttggtttgatgcctgttggttgccatcttttaactagggatgttttatcaaaatgcccagccaaagtgtccaaacaaattataccttaaagtttgaaaatgtctggcacttctaattcaatgcctgttgtgccaggcactgggctgctgaggaactgagtcccgtccctgcaggctagctagagaacacacacacacacacacacacacacacacacagagtggtcttacaagtcagttttatattctacctatatgcaataaaggtattattatgttgaggtgccttgatataaaaatttttcttaaaggagaggatgcctaaaacaggcattacctgaaacctcctctctccagcattggttgtcttctgtcatgactcagggttttcactgagaatgggatggaaatgtggtctaaagatagggccaatgttgggactggatcccctctgggaagtcagaccaggctagggcaggtccttgaagccatcaggaaaagcctctggagccagaaacaaaacaaaaaaaaaatggtgttaactaaactcagtctcaaatcctgaataggactcaagtcaagcaaaataattaaaggagttagcaaagggcaagtcagagagaccgagcaacaccaatgtcttccgggagccctgtggcgagtgacagagcctggactctggagtagaactcatcttgtgtcttcttctgccactcgttagctgggtgaccttgagccaagccccttaacctcttggaccctatgttcttatctctaagtaggggctggtaatatcttcccctttgaggaatgccctctaaggggtgttgtgaagattcggtaaggtggcaggggtaggactcctggccagaaacaggcacataataaatgctaagtctctccttctctccacctgctggatgctgtagatactaaggatttcgatgtgaatgagacaaaacccctgccttccaggagcctttgagaatcagagaactagacccatttccagaacaaggggatgcagggtctggataaagttttggggatcaatagagcagagggctcccagaggatcccatagggttgactcctaactcaagggcatgagacaacccccaggaagggcaccctggaaggggtccggctgtccctgatttacttgtgggcactgggggaatgcccggagccatccagccctcagggctctgtgtgattctgggttcctcccataaaagataatcagattctttcacgttaatgtctttctccacctcattgcacatcatgcagctattcattgactcagcaagtatcagctttgcatgcgaccttggcctacccactttagcttttagtaatagctcccttcttgaataatacaaccagtggggaaacagaacctaactcttacctctgggaggcttatttgctttgagaacatatgtcctgcagttttgttcatatggcagtgaagtttcgtgcacacactctagagccaggcagcctgggttcaaagcgcagctctgccaggtcctaactgcatgaatttgggcaagtcgctcaacctctccatgcctgagtttcctcatctgtaagattggagcaatggtaatacctgctttttagggttgagaagagaattaaatgaattaagatgggtaaagtgcttagagtggagctttgcaagtagtaagtgctatgtaagtgttcgatttaaaatgaaagacccttaaatacattctttgttcatttcacaagcccttcatttcacaaccttacatttcacaaccaagctctgtctcccctggaatccagccataactctgctcacaagtgtgagacaggccccagcagagctgcacgaagaggagagaaggcagccccccagactcccaaccccctgtccaagatggcaaaaccagaacacagcctctgtaccaccccagcaggtattcagaatctgcaatctccaaagcccacttcaattgtaaatgtagagccacgtgcgctttaagtcacctgtcactctggaggctcttttgctcagttcctcaccattagcagggatgacagggagtgcaggagtgcggtcgactcccagatattggagagcgctgggctagctgcccattctcccggcctccactcctctttgctgtccagccatcacttgctctttgaaggcaaacaaaacagaaaacagtgccaaaagtatgggaagaaagccagcttctcccctggggtgcctgtgatgccatgcccaccctccctgaccacgcagcccctgtggaccctcagggccccaagcccccatttccatcacatgcgtacacccatgtgtgtccatagccgcccatctcagtcaataaggctgctcctgcccacttggaatagtggtgacaaccaggagtggcttatgggaactatcccaatggcctgacagcatgtccgctgcaaaccgctgaggtaggacactgccctcatgtctagctgatcagcaagaggcgcagttgctttcttaggtaacattgctgctgtgtcctggccattgctggggggtggcacttaatctacaccagatttttccctcctgtatcttccaagctgcttggatcttggtgctgaattaggttggactttgtcttgtggggaagggaggactatagaccctcaacgtaagcaatggtcagactattctaagaaaactcgccgaattaaagcatgaggtaaatttagttctgacttctgtccaccccactgccactgtccccttttatcccatgatcccttgcttttcttttcctcctctctccctatctcttgtgtttgacgcatgataggaattcagaaatatatgtttgtggatttgtttattcacgtagcaaaccatttcttgagtgcctaccatgggccaggtagaatgggcggccccgggctgcagtggtttcttcagcccctctccagggtttacactgtgcaagacggtttgtgatgggtcctcccatcgaggaccacactcttctttctctgtgccccttggtcctcagtctctgaccccacttcaaaggcagcattcactcagggaagctcccatacaatgctagtcagagtaaaagtttggacaaattgccaggaagcagcttgtcagtatgcataaacagcctttaaaatattactactctttgacccagaatttcacttctaggaatctgtcctaaggaagtagtcacatgcaaaagatttatgtaccaagatgttcatcaaagtgttgttttataacaggaagtctcagaagctggataaatatccaacctctggaaatggttagatagaatagtatgtagccattagaaaattatgtctatggggtttaaaatgtcatgggaaaacacttctgacataaaagagcatgagaactgtatatttagcataatcttaactatgttttagaatgcacaggaaaaaaatgtacaaacatattcatagtgatgtctctggtggtaggattatgatcagtaagtacttctgtctcttcatattttcctgtatttgataatacatgcatatgttgtttttaaaataagaaaaattttaagtttaaaattggagctgaaaagtgtttttaggtcaggcgaggtggctcacacctgtaatagcaccactttgggaggctgaggcagtcagatcacttgagcccaggagttcgagaccagcctggccaacatggtgaaaccccatctctactaaaaataaaaaaattagccatgtgtggtggcacacatctgtaatcccagctacttgggaggctgaggcatgagaattgcttgaacccaggaggtggaggttgcagtgagccaagatcgtgccactgcactctagtctgggcaacagagtaagactctatgtcaaagaaaaaaaaaaaagaaaagcctttttaaacagtagcagacataactatataatccttactaagctgtcggtcaaatttttatttatatatttattttattcatttattatttttagacagggtctcactctgttgcccaggctggagtacagtggcgtgatcatggctctcttcaaacttgacctcccgggctcaagtgatcctcccatcttagcctcccaagtagatgggaccacaggtgcataccaccacacctggctaattttttttattttttatttttagagatggtgtttactatgttgcccaggctagtctcaaactcctgggctcaagctatcctcccacctcggcctcccgaagtgctggggttaccagcatgagccactgtacccagccctcaaatttttaaaaatctataagagacattattggacaattagagaaattcacatatggacttataatagtatcagagtgtgtggtgtgatggttctggagggaatggactttttctttggagacaggcttttctatgcccacccttttatcttgctaacttatcatcatccaggttccagcagaaacattacttcccccaggaaatttcttaagggtgcagtatcatgatgtctgcagcaaattctcaaatagctcaggaaaaaagtacgtgtgtggtatgagtgtgtgtatgtatgtgtgtatatatatacacatatatacacatatatatacatatatgtgtatatatatacatatatgtgtatatatatacacacacatacacatatatatacacacacacatacatacatgtatttttatataattatatatgcagagagtgcaaatgttgccaagttaaagattggtgagtctaggtgaagggaatatggtatttattgtattatttgtgcaacttttcttaagtttgaaaattttcaaaacaaaaaattggaggaagaaggcatgccagtctaccccaagccctccattggaatgctgaaaatctaaacaatgtgatttggcaatttcatttcttttctgttgtgggccagtagtccttagatgttggggaagggggtagtcgctgaggtgtggttgacttaggatggaagaagcagaagtcaagactcccagggtcaaagtggtttgctctgctgacccaagtgtgggaggcccagagtcagcgtttcaggtgtgctaattcagcatggttctattcacggccaaagtccaccctgggcacctctctggcagcaatcttgggtgactctactaaggccaggcctccatgaccctatgtctggatcccatatctccacctctcccactgtctcaggaacggtgcttagctttttcttttccctctcctgtcttctttgccagcatgtagaaagtttaaataattcccctctttacaacaaaacaaaacatacccccttcagtcaaccaccctagctctcttctccttttcccagccagatttttttaaaagcatcctaggccaggcgcggtgactcacgcctgtaattccagcactttgggaggccaaggtgggtggatcacaaggtcaggagatcgagaccatcctggctaacatggtgaaaccccatctctactaaaaatacaaaaaagtagccgggagtggtggcaggtgcctgtagtcccagctactcgggaggctgaggcaggagaatggcgtgaacctggtaggcggaggttgcagtgagccgagatggcgccactgcactccagcctgggtgacagagtgagactccgtctcaggaaaaaaaaaaaaaaaaaaaaaaaaagcatcctcagcactttggcaactccatctcctcccaacatgtccctgttactggaatccagccaggactcagccccgatctttctactctaaccagttgtctcagttaacaaggacaggtttatgctgcagtgacaaacaagatcccaaattcttgtggcttcacacatctggcaccacctcatcttccagccttaggagtcatcttttagttccttgaaaactctttacagttttctgttggggccttgtcatatactattcccctggaatgttctttcctatcccctccctttcaccttgctaacttgtgcccatccttcaggtctcagcagaaacatcacttccttggggaagttttctccaacacccacactacacaggtgtcccatctacactcctatgactttgtggtacttgtctcacttcattttccactgccttccccacaaggcacctgcacaagggcaaggaccgtaccactgtacctatgtcactcattgctgtggtcacctgcactctggctgcctaccttaactacacattagaatcacctgaggagcttttaaagccacaatgcaagactccaccctaggccaattggatccaaatccctggggtagggccagacatcagtggagttatatatacatatatatattttgtttgtttgtttgtttgttttttgagacagagttttgctctgtcacccaggctggagtgcagtggcgcgatcttggctcactgcaagctccgcctctcgggttcacaccattctcctgcctcagcctcctgagtggctggaactacaagtgctcgccaccacgcccagctaatttttttgtgtttttagtagagatggggtttcaccgtgttagccaggatggtctcgatctcctgacctcatgatctgcctgcctcatcagcctcccagagtgctgggattacaggcatgagccactgcacccggccatcagtggatatatttttaaagcactgcagagaattctgttgcatcagcttgagaaccactgatctgccttgtgcttcacatttaaaacttttttttaatgaataaataaaccccaaaaaattaatctccctaagcctccctagaagataggatggtaaggatattttcctaggtaaaaatatgttaatttcatatttcatgaaatttcatgtttcatttcaatcaagctctgtcatacaccttacatggggcaagcccagtgcctgggcagggtgtaattatactcattacacaggcaaggaaaagtcacattaggtgatggagcacaaataggcagttaatggtttcagggctagttaggatatgtttgtctttcaattgcaagtaatagaagcccaaagaaattggttatttatataatataattgattggttcccaaatttgaaaaattcaggaatagacccagcttaggtacagctggatccagtcactcaaacaatgtcacaaagaaccctttgacaggaatgtatcctgtgttgactctactttgctctgagtagtctttccccaggtgatgataaaaatggtcatcatcgccaggcttgtgtcctgtttagtaggaatatacaagaagagctcagtaaatgctggccccaccactaagcaaaaacaaaacttttgttgttgttattgttgttttaaataacagcttagacctttcttctttccttgttattctctttcatctgtaatccagttttctacttctgaagtatagaatgttctgatgatttattcttcattacccacaacttgcacatgtttatttaaaaatgccaggattgcctggccgttgtgtgctgttaacctttgtttgctgttagtggatccctgaagttcaggctcccaggggagcagataatgggtatccagttcctgcaatatccaccctctggcaagccaagttccttcctgggtaaggttttgcctacctgcattcctagggaagtttctgggcctgaccaccaagccagctctgagaaggggtgcataagccccaccatgctttggctctgtccctatagaatattttatgttgttactgaaaactaaaggaagatgggtgcggtggctcatgcctgtaatcccagcactttgggaggccaagacagattgatcactcgatgccaggagttcaagaccagcctggccaacatggtgaaaccttgtctctacaaaaacaaaacaaaacaaaaattagccgggtatggtggcatgcacctgtggtaccagctactcaagaggctgaggcacaagaatctcttgaacctgggaggtagaggttgcagtgagccgagatcgcactactgcattccagcctgggtgacagagcaagattctgtctccaaaaaaaaaaaaaaaaagaaaaggaaagctaaaggagagagactaaaatgatatcaggttcctggagaacaaacagacatgattttgcttcatggcaggacagccggaagaagtgggattatatcctcacattacaaataagaaaactgagactcagaatggttaagtcacttgtcccaggccacacagccagtaaattacagaaacagaatttgaacccaaatcttccagctccaaagcttgtgttcttttcactacctcctgcttaattttttaatttctaagattagacccttcatctatccatgacacctgcctgtcatcccctgaaaaaaggtgaacgccgttcagaaatttttctagcctgagctcactcccagttcacttatttttgctttgtcatggctgcccagtccccacttgtagaccaggaataggtcatggctgcggggactacacgctgtcgctgctgcaagggccggcctctgtttccggggctgagtgggggccagacctgccaggagcaccatcttctgtgggtcctgcctggatgtcacatcccggccccaagaagtcactgcaaaccttcgtattattgagcttcacatcctagaatttgctgtcactgtggctgctgcatgaagttgtcctgagagaaacgggcattgtcattaacagggaaattgatggtctgggggaaaagtcatcctcattctcttgcagatctatgggtgattgagactggctgatgttgaaggggtttctcagccatcgtgtgccatgttatggaacagtggtgtagccagccatttgacacccagcgctgacctttgtttaacaacctcacctatatatgacaaaatgattgtcagaaataatcgtgtaatgaaatgactgtaataatggccagaaaagaaacgcagatagtaaaatgtttctcttgttgaactctgtacatataattgcaccaggatttttttcaaataaaaagtaaatattatactacaaaaaagggaaaaagcacaagcatttattaaatagctttctatatctttctgagttttgatcctttgattgcagactgatgtaatattttatgtaaatcattgcttggttactaagtgaactttaagaaaagtgagacgtctgcagaagttgcccataatttagcagctactgtattgtaccattgatgtacggctttattttcttgattaattatttaaacaatataattcacaattttaaaataataaatttccacttaaaatggtatttaaactcagcaaaatatatcatctatgagtaaaatttgtatttaccaagcaaaaatattacagtttgtggttcacatgctgtctcactgttttaaattttaaatacaaaaactccaagtaggctgggtgtggtggctcacacctgtaatcccagtactttgggaggctgaggcaggcatatcgcttgagttcaggagttcaagatttgcctgggcaacatagtgagatcctgtctctactgaaaacaattagctgggtgtggtggcacatgcctgcggtcccagctactcaggaggctgagataggaggatcacttgaaccctgggggacagaggttgcagtgaggcaagattgcaccactgcactccagcctgggtgacagattgagaccctgtctcaaaaaaagaaaaaaaaaaaagaaacacaaaaactccaggtggtcgcacagaatgacaggactgaagtaacttagctccaatttctgtcttcataatcactgtcctaccattgtctgtgcttagaatctacttgcttaatgcaggaacatgtgttctcacagagatggaaaatgcaaatggcgccagaagcaagctggaaattctgaaccattaagaatttactctctgccaggcacggtggctcacgcctgtaatcccaggactttgggaggctgaggcaggcagatcatctgaggtcaggagttcaagaccagcctggccaacatggtgaaacttcatctctacaaaaatacaaaaattagccaggcatgatggtgggtgcctgtaatcccagctactcgggaggctgaggcaggagaatcgcttgcacctgagaggtggaggttgcagtgagccgagatctatctgcaccattgcacttcagcctgggagacagagtaagactccatctcaaaaaaaaaaaaaaaaaaaaagaacttactctcaaaataaatacgtgtggctgactccacatatggtagggccaactgtataactagaagttctccaaataacttctgtggagaaaaaaaagtttattaaaggttaacttttttaaagtgctaactagaaccttactaacactgagatcgcaccaattgtttataacttagacagggccgggtgcagtggctcatgcctataatcccaacactttgggaggccgaggcaggtggatcacttgatgtcaggagttcgagaccagcctaaccaacatgatgaaaccccatctctactaaaaatacaaaaattagccaggcacggtggtacacgcctgtaatcccagctactggggagggtgaggcaggagaatctcttgaacccaggaggcggagattgcagtgggccaagatcgcaccattgcactctagccccagcaacaagagtgaaactctgtttcaaacaaacaaacaaaaaaaaaaacctcttggaccaggaaaatattttttaagggaggagtattttatcactggcattgtttaggattgcaggcacatgatgctaatgaaaagcagactaactattagttggttttattactgtttttgaactctctctctcccttttttttttttttgagacagagtctctctctctgtcacccaggctggaatgcagtgactgcagtctcagctcactacatcctctgcctcctcagttcaagtgattctcgtgcctcagcctcccgagtagctgggattacagggcaccacaccaggctaagtttttgtatttttagtagaggcagggtttcaccatgttgcccaggctggtctcaaactcctggcctcaagcgatctgcccatcttgacctcccaaagtgttgggattacaggcgtgagccaccgtgcctagccctgtttttgaactctctagagacagtccagccccttattacttgtcctgaggcagctgctcccttcacctggccccccgcattgtgttccggacccttgtcctggtggtgctaaagaatatctctgtcgatcctttggggactggggaaactgaggcccagtgccacgcgatgccatttgttcagggaagattaggtcatctgctaggtccccagtcacttgaccttcttcccagacaggaagaagctgctctgggtctctcagtgctccacgtgtctttgcacattgaaatgttttctgatttttttttttttttttttgctgttacatttacttttaaaaaataacaagcaataaaatgttacatttgagaaggttgaaatgagaattgatttgagttaaattctagcagatttttcttagaagaatgatatcatcatctccagctacctgcaattgatctactctgaattaagaaagagacttccatttgttgtttatattttgcactcttgatgtgtttctttaaattatggtcatgggccaggtgtaggagctcacacctgtaatcccagcaccttgggactctgaggagggaggatcactggaggccaggagttcaagacctcgtctgtacagtaaattttaaaaattagccaggcatggtagcattcacctgtagtcttagctacttgggaggctgagatgggaggattgcttgagccagaactttgaggctacagtgagttattttcacgccactgccctctagcctggctgacagagcaagacctgcctcaaaaaaataagtaaaaaataaattaaatttcaatcattagcagtcattaggatatttaaatacagtatgttgaatcaaagttacgcatgtgtgtatttttttttccagagagttgtttatcatgtgggttttaatttaactttaaaaaaatgttggctggacagttgcccaaatggtatcatcagccatttggttgagaacgtatgtcctgcgggctcctctgtcactggagttttgctagctgacagccactggctagttagagactgcagtcagcacagatgcaggcgtggacttgcgcacgtaaccatgtcaatgcaaagccatcacttcttaaaaattctgaaccctgctgtctgagatggtggtgcagcggatagaactctgctctaagaggcagtagctaattccatgtcttctttgcccttgactagctgagtgactttgcacatggggcttgcctctctgttgccttgtctgcaaagtggaatcatcttttccttgctagacagaaggtggaccctggacctatggcctttttgagtttcccccccgcttcttagaaggacctctgatcctactgagtttaatacccacgggttaataattgggaaaagcaaaggaagcgcttctgtttaggtaattatatgcatgtttttgtctttttctggctggaaagatatccaagccactgggaaggtccgtggctacccagggtagccctctctggggagggctgctatatccaagagcccctcatgagaatttgaaaatcgaccatggtagggcctgctgacttttgacagctaatggtgtgctgagaattgtccctccaaagatgcctttccattccctcgggagagtctgggcagcccctactgggggctgggatgctggctcttccctcagcctccaccccaactgctctcttccctcctcccctccccagccccctaatttctctcacaaggctttgttctgcagcaacctttcctaatgcagtcctggcctcttcgcagcttcattacataaccttccgtggactcctggtccaaggatcaccccagaaagccagtcagaggtaggcacgcagctggggtccatttacttaccttccccaccccctcggaactcagaggtggtgcaggaatttggactccaagaattaacagctccaccaccatcaccagagccaaaactcaggatgcatgtgcttcatctgctgcttatttccagctgagagccagtggtgccatggttccttagggagccggtcccctgatgccggctcctggccccaaatctctctgatccgggctcttccagaatgtcttgtctccaccatcgcctttgaccaatggtgtccctttgcctggtaatgtcccctttgcctgatgatggccctgtcactcctctctttagcacagaggaggctgtttcatcccttcaagcctgccctcccttcaagtcttagctcaagttcaccttctccgcagagccttctccaatcttcttgactacgtctcctctcagctccagcaacctctgtctctggcactgattccttacttagctaagagaatcacagacacttggggctcaggacaatctgctttctctcttcttacccatggccttggactgtgtgtacctctttgtctccactcccaaacccaacccccagagggcagagagcatgttgtctgtccctttgctcagcatgaagccatgcgtgtggtagatcggcagagttccataacttgtgttgaccgaggggtcactttgctctgaaattacccctgtgtccttcagtatttgcacagatagcttcctggccagaccgaatatatccaagggcatggcccacctctgctcctgtttccaggtccctggtgggggttagttcatgccttcctcataatctgcccactggcctggtcctcaaggtcttcccaactgctcagccagagttgagaaaatgggtcgctccatcctgtttgtgtcgttctctccttcctggcccactctcctgcccacaggtatccaggggctgcctgtagcattagaggacatacatgcacatgcgtgggcatgggacactcacgtagcctccaagcacagcatcaataatgcattctgtgctttatagcatggaaagctgctctaaactttattacacagtggacatgtctgaagcagctcccaaatccacccctgagtgtgttggaattggcaagcctatcacttgggagtctagtttttttgttcgttaataatagatgcttcctgtggccccagcttggcaattttgatttaaagtgatcttaactgaagagactaatggacgggtctgaatttgtgccttttaagcacaaagtattgctcttaattaactggattctatcctttgagcaggcagaggccttcccccaagggcgtcattaacgatccacatctggacatcttccaaagccttcttctgtttcaggccaaccgcaggtgtgttcctgaacacccaggaggctatgagagccacatatgcctcccaaatacacacagtgtgcatgcccagggacatagagcagtgtgcaaagtcccattccatctctctccacctgggagaggatggctcttctgtctgattcatggctcaaagtggtaaaggagctccccactccccgtcccacgcctactcagagtctgcaaatatgtatgcgatatgagagctcgtcagttagctgtcttcagtgtggcgcacatttgaggagtctgactcccctccagcacaggccaatgtgcactgctctcctatctttgtacccccactgttgcactgtgcagaggttggagccatagaagtaccagagctgtgaaaggagaggccccctctcacctctgccctggtctccatccccactttctctaggaagctagtaggtgctgacaggggagagaagggaggggaggggtccagaaacagtggctcatgcctgcaatcctagcactttgggaggctgaggcaggaggatcatttgaggtcaggagtttgagaccagcctgggcaatgtagcaagaccctatctctacaaaaagaaaaaatgtaattagctgggtgtggtggtgggcacctgtagtcctagctacttgggaggatgaggtgggaggattgcttgagcccaagagtttgaggttacagtaagctgtgattgcaccactgcactccagcctgggcaacagagctgagaccctatctcaaaaaaagaaaaaaaaaaagaaaggagagagagagaaagaaaagaaaagaaaaaaaaaaaagaagggaagggaaagcccagaagagtgtggggagaggaggcggccgtcattctggggccctcagtgtgcacaaccagataacacatgctctgtgggcttttgtaccattttgcttgagcataaagaaaggaaggctgcccctaaatagaaagcactctggaggcaaacaaatctgactccaatcctggccctgccactttcccagctgaggacttagacaagcaccctagcctcttggacattctcagagccatctgctgcaagtgggtgctgccatacccaccttactgggcaggcttgggggaccaagggtggtaaatggctcagtctttcatgatgcggccacacagcaggtgcgccatccaggtccatttctttccttcctttcccccaaatcaagttgtcattaaagtactagtccacattaatgaaatcaactgtattaattttctatttgctgctataataaatcatcagaaatttagtggcttaaaccaacacaaatgtattaccttacagttctggaggccagaagccctccataggtgtcactgggctgaaatcaaggttttggcaaggttgcggtcctttctggagggtccaggggagaatccattttcttcctttttccagcttctaaaggtttcatgcattccttggctcatgatcttctatagctatagtcagaaaaattttccatcaatcatcttcaaagccagcaatggcaggatgagtcctcacatcaccttgctctgacaccagttctctgcctccctcttccacatgtcaggaccctcatgattactttgggctcactctgataatctgggatgatctctctattttagagtcagctgactgggaaccttaattccatctacaaccccaattcctctttgccatgtacagtgacatattcacaggttctggggattaggacgagcctgtctctgaaaggctactttacatgaaaattcatttttttaattaagatttttttttcctcttgagacaaggtctcactctatggttcaggctggagtgcagtggtatgatcacagctcactgcagcctcgacgtctctgggctcaggtgatcctcccacctcagcttccctagtagctggaactacaggggtgagcccccatgcccagctaatttttttttttttttttttttgagacagagtctcactcagtcacccaggctggtgtgcagtggtgcaatctcagctcacagcaacctccgcctcctgggttcaagtgattcttgtgcctcagcctcccaaggagctgggactacaggtgtgcaccaccacgcccgactaatttttgtatttttagtaaagatggggtttcaccatgttggccaggctggtctcaaactcctgatctcaagtgatccaccaacctcagcctctcaaagtgctgggattacaggtgtaagccaacatgcccggccccagctaatttttaaatattttttttgtagagatggggttttaccattttgtctaggctggtcttgaactcctgggctcaagcaaacctcccaccttggtctcccaaagtgctgggattacagcatgagccactgcactcggccttaagagaagatttaataattaatactttacaacaagatctggaagaggtgggatgagtaactaaatgaggatacaagtaacccgggtcatatttgctaatacccttggtcacattgaacttgatatcttatcagattttcctaatcagctcctttagcagcagtgttgcagcatcttatctcattttgttttttgtttttttgcctagcacatgcctgtaaatcactggattgaggtgtttagatgtttgttgtcctttggatgcttcttataaatccatatttcatggctccctggaaagtgctatgcaaatgataagctgcaaggatggaaaggaaattgcagtgctcctgaattgtaaatgggcttttacgaggaggtttctaattactcgctctttctcttgaactgaggagttgaagtgtaggtggcagatccataacagataatcatgtgtgtgatgtgacttcagcctgagcgtcgaggaccaagtcacagagcaggaacagccactctccagtgtccttggggctacgtctgaggagaacctgggatttcatatatgacctgcactggctggggggctctcttgacgtaacgtgttccctctgagcatgttacagattctgacattcttatgttccttctgtggagagacatgtacttagtgacctaactcactttagcatatttttgctcatcgtttgtgtagcttaaaggaatcagataattaccccctccccactactttcggaagcacaaatgcaatgccctagaattgtactggggactcaaaaagaaaagagagtagtaaaatctattaaaggggacaaagacagcctatatactacaagctttctatttttatggcagagaatgccattttctaagtaaacagagaactgcatttgacctgcaatatcaaatgcatggatttgatgctttggaaagcaactgttttctgcgttaatctgggtgtcttccgtgaaatgtcctcctgcctttggcttaaacactagctttgtctacagccattccatcctgaacctgcccaatcttgtctgaatcctggtttcaccactgacaagctgtgtgtccttgggcaagttacttcacctgtctgtgcttcagagtcctcatctgtgagttggggaatctggacagaatctaccccatagggcgtagtgaggatgtgttgaattatcccaagtggctacacagagtaagcactcaaatgatgtcatcgttgtcatgattgctgttaccagagcctagagttcattctgatactcgagtctgtggcccatccagcccaggtaaggaatagttggaggagttgggcatgttcagcttgaagaggagacgacaggggatatgggatagttgaatctgtgaagggccccctgggatgaagaactggcatgttctgtgtggctccagggcactgagcaggacccatttgccaaagtctcagggacacagtttctagctatagacagaaaaattttctgtcactcagaggatgaaaatagaatgagcccccttaagaggtaatgagctccctgtcattggaaggattccagaagagctaggtaaccactttaggtgctatcaaggggcttttttctttaaagtcctttccaaaagcttctgagattgcataaacaataggaagccatcttggtgctttaacacaaactctccccagtgatgagggttgagccaaagccagattggcaagcagagaggagacttgtgtacaaggagttcctcgagtcaattgctttttccttgttctagccagccagagggctcctgttggaaaacaggagaccggagaggctgaggcctgaccaaaccagcttctgcaggccagctgggaggccacaactcctacctacgggaaaactgaagggcatctctatttttagattagcaaaagaaaataaatttaagtttgagtctcctttgcaacttttaaaagacatctttattgagatgatcattcacattctataaaattcccccactttgagttacaattcagtggttttagtcttccttgatgattttgatggtcttttcttaaggctcttggaagacccagaagcctctcagacacaggtgggtgtggagggcgtagcacagaggcagacttctcatttcctgggtctcccctttaatgactctcagagacccctccttccccctgcccctggcttctaccccaggggtgtagagttttgccattttccaagcagaacttcatttcctcttctgtgtctacactctttgtgcttctttcttgccagctttttctcctttgcccgcccttccttccttccttccctccctccctccttccctccttccctctttccctccttccccccttccacccttccccccttccccccttccctccttccttccttccctccttccttccttccttcctgccttccttccttcctgccttccttccttcctgccttccttccttccttccttccttccttccttccttcctggtatgtgactaatttctgtttcaggacataaatgttgtccaggctgttctttggtctttctgttggataatggacatttggcattgagagaggctgctttttctgaaatcatgttcttggggcccagaacctaggtgtgtgcttctgactttgttttcttcctgatccaaattctgatatgtccatttaaattgatctagacccacagggcactgtgggacagatcctcagtggaacatgactctgtaacgagagcattttgttttgtcaaaatgagaacatattattgcctttcatctgattgtaaacataatacatgtttataaaacagtataatgagacaaaaatgtagacactaataagggaaaatctccctaattgtatttctcttcacagagaaagcccctgttgggcatatatactctagtttgtttatttgtttgactacacatatatgtattcttttcttatgtataaaaattctgaacatgcacatttctgcaactactgttttcacttgatgatgcatggacctctctagagtgtacgtttcttcttccttacaaagcagttggcttcgcccagggtacaccaggacacggttttggctctgtccccagggtgtcacgggaccaggggatgatctcacagggtctgccatctgccctgcctggccggaggctgcatcgagagggccaaggggcaccacgtgtcgtgggtactgtcaaacaagagccttcagagccttccacagtctttcttttgcttcccagcattgcttccccgctggtggactctgaatctagaactagctccaggcgcctctccaaattcagacgggagctggggcactattataatgcaaatctaggcaaagccctcccaataccaggatccagaatggggtggggccctttgccctgaaaagctgtttagtttgaaaatacaaacaggagacagaaaagtttggctaaattaatggataaagttttaacgatggtaaccatagtagggttcatcgacagccagcgatggttctgaacacttgacatgtattaactcacctaatccccacattttacagacaatgcaaaggaggctctgggaggttgagtgacttgccccaaagtcgcacagctcctaagtgaaggattcggagtggactccaggcagcctggtctgactccctgcactgcgctgtgcttatctctggccccaatgccgccatgcagaagtgtctgggggcactttgtctctgtcagacagaattcggagatgtgtatgcttgccctggtatggcacttctctttttttgagacagaatctcactctgtcaccctggctggagtgcagtggcatgatctcagctcactgcaacctccgcctcccaggttcaagcaattcttgtgcctcagcctcccaagtagctgggattatagatgtgcaccatcgtgcctagctaaatttttgtacttttagtaaagatgttgttttgctgtgttggccaagctgatctcgaacttttggcctcaagtgatctgcctacctcagcctcccaaagtgctgggattacaggcatgagccaccatgcctggcagtgtggcacttcttacgtgtgttcagcggacactgtttatcttctgtccctccaagacggtgctgagctcaggtcgttcattactggcagacaactgctgatttccaacagaattgccatcctcttctcccctgcgactttcagagtgtgacctcagactcaaaaattagaagtgaaaacatcttaaaaactatcaccttttcttcctaatcctcctctcccctccctgtcttccttgttgtccccatctaatgaactatcatggcaaaaagagcccatttctggtcattttctgtggcctttcaaactcccacctaccccactgctcctgggtgcattacccgaaagctgagacttcagtgcagaaagtgccaggccctctgtccccccagatcgccttccttgtcttccctgtgcttgcctgtcacattgtgtgggttccagcgctggaaggaatgaggaacagattctctggttctccttttgaagtttaccttcgctccaccacttctgagaccttcccggaagttgccccttgtttctctcctctccagggctgccccagagctgcctctcacctcttcctgctgtcaccccaccaccatcagggcagaagttgggacaaagcctctcctactggctcctgcttttctcccttaggtccagcctcctcttctccatcttcaggagtctccttctccactcacacgtcatgacttcagcacctcgcatcagtccagaatatgactgcttgttcaagtgccacctttctcatgcatttttttctagtgacaatcacagccaccctgtggggcaggagtgtcatcatccccatgtttcaaatgaagaattgcagttcagagagggcaagtgactggcccagcctcaacagctagccagtggaccccaccagggcttctgactccagtccgggttccctttccacccaaatccatggagggagctgagccgagaacaggtgtccttcaggaagacgtgaagccaaagcctccacctccaaactcaggggcccagggagtccaggcacccatccactcacaaggctggatatggtgcattccaggagaggggttgggggcgagtggcctctctgtgtacccgtggggatagatgcgcaagtggcatcgccacatcgtgagtcctggcttcatgggtgagctccaggtccaacgagaagccaagcagggggcccttcaagctcagctttgggcccgggtcggggtacagggtagagcgggcctccccagcccctgccatgaggccaaggcagtgcatcgttcgcagcgtacattcagaaaccaaagcctaggagctggttatcattccggtttacagctgatggaagagcaggtgcttccgagaacccacagtgctctttggccagtgacccaagggtgcctctgagaggcctcgcagcacccggaggtgctgctgaggcaacgccctgactgtaagaaggaccattcatcctcagagagtggccgtgatgctgctgcgacagtcccaccatccctcccgactctcactcccaacagacttcccactgtaaagctgaactctccagcaaatcacctctcgccagactctctcctcactctctctgggtccactagaggttcctcagcctctctttgccttggttttcccagctgtaaaatggagcaaagagggcctatgtacccacaaaggtgtggttggagcgactcctcctacattagggcctcgagtggggcttcatgattggttggtggaggtctccaaacccacccagtgccaccgaaggctgagactgcagatgcaatgccacaggtgtccttcctcagcctgggcagctgaacatcatgtgtaaaacggggataataagataataacagccccttgcacctatgtggctgtgaggattaaacaagataaatgtgtaacagtgcctggctatagaaatatttactcttgttattaagggaagaatatgtgtggctaaaaagggatcgaagatgtaaaagccaatccctccccctctagcatatttaagggtaatgttgagttggtttgtggaccatttgctgcctgttagagctggaaggtagggaccccctctcaacagcgatgctacaaattatacccattggaggtcaaccaaaagacaaagcttattggctggacatggtggctcacacctgtaatcctagcactttgggaggccaaggcaggcggatcacttgagatcaggagttcgagaccagcctggccaacatggtgaaaccccatccctactaaaaatacaaaaattagctgggcgtggtggtgcacacctgtaatcccagctactcaggaggctgaggcaggagaatcactagaacccaggaggtgaaggttgcagtgagccgagatcgcaccactgtactcaaaccgaggcaacagagggagacgcaatctcaaaaaaaagaaaaaaagacaaagcttgttaataccagcatattgttaagggaataaagtaggctgcagaacaactggtgtaatatggtgccatgtagggaaaattacatgtgtgcataggagaggggtctgcaaggttgtgccctaagatgttagagtggttcctttgcttttctcttttataattttgtatttgacttttaaataaggaccataaatcacttttataaaatacattctctccagcccctactactcctttaaagaataagagtggtttgcccaagaaagacagttttttttgctctggttttcttgattctgacatcagaggaaactccttctcatccacttggggctctgggttcaggggattcatttcaggcagattaaagtggtgaccaggggcattcgtggacacagggagggacaggagcaccatcagtttgtctcacacaaccactgtcatcctcactgaaggctgttgcctgatcaaaaacagtattgggccaggcacggtggctcacacctgtaataccaccactttgggaggctgaggtgagtggatcacttgaggtcaggagttcgagatcaacctggccaacatggtgaaaccttgtctctactaaaagttcaaaaattagccaggcgtggtgggtgcctgtagtcccagctacttgggaggctgaggcaggagaattgcttgaacccgagaggtagaggttgcagtgagccgagatggcaccaccacactccagcctgggcgaccgagggggactctgtcttaaaaaaaaaaaaaaaaaaaaaaaatatatatatatatatatgtcaaaaatggggtagtttttagatctatagtagttctaaaaacaaaggccatccaagcatgacagatttacaagcactattggctattccagtagttacaatggaggagagaagcttttagttaaaacaaacaaacaacacaacaaacccagaaaccttaggtcaaaaccaaaattgtcctctcagacacaatctgggaattttctcatgacagtgggcattagccaactgacatcagcagcaaccatccgtgtgcacacagtggcaccacctcctcccaaaaagcagccttcatctatgccctcatacaatcgttgattattctctttggattgaggcccggaattatttaagtttcttcttgccagcatgagtctttcctttctgtatgctccttatcttctctctttaatttggcagttctgcttgaaatctgggtctttcattagtagtagttcaatttggttccagaacattctgtggtgtgatgcaatgtgaccagagctcacacttcagagctcttcaagggccagtcttactgagcacctcccagtggctgcctgtgtgctgggcgccacttgtggtgggcaggagagaggaggggacacaaaaggagacacagctccttcttagaagctcaaagttggggaccagctgccacagaagagtatgtttagcatctgagacaccaagatccagcgtcacaagggtgtttattaagcctcctcatctctttctttttctttttttttttttttttcctcaggcagtcttactctgtcacccaggctggagtgcagtggcatgatctcggctcactgcatgcaaccaccacctcccgggtttaagcaattctcctgcctcagcctccccagtagctgggattacaggtgcccaccaccacacccagctaatttttgtgtttttagtagagacagggtttcaccatgttggtcaggctggtctcgaactcctgacctcagatgattcacccacctcggcctcccagtgtgctgggattacaggtgtgagccaccgcgcctggccttgctgttgattcatctatagtatgtttgacttgatgacctccagttaccttagacagaggttctcatctaagctccaactttccatttcctttgtcctcgtctttccccttaacccctccacatttctctcaaaatcaccccacttctaaaaaatactgtttatttttcttttaaatttcaaattatctatactcattgaaataaatcaaaatagcatggaataagcgaaaaaaatggatcccacccttccccactcccattccctagggctaaccatagttaaccatttaatgactaggtttttttgttgttgttattttttatttatttattttgagacagagtcttactctgtcacccaggctggagtgcagtggtgtgatctcggctcactgcaacctctgcctcccaggttcaagcattctcctgcctctgcctcctgagtagctgggattacaggtgcctgccaccacacctggctaatttttgtacttttggtagagacagggtttctcaatgttagccaggctggtctcgaactcctggcctcaagtgatctgcccaccttggccttccaaaatactgggattaaggtatgagccaccgcacccagccctcctgggctcttttcctttagttgcactcgctccccgctcctggagtagagggatttccgagagactgtgggctccagccttcacctaggcccaggactaggatgcctgccctaacatttatctttataccttaaagcaaaacagctggaccataagcattcaagaacaaactgtgaataaggagaaagttctcccaggaaacaagagctttagttatgttgggccagcccttatattccttagctgttaccagtcactgcttgatttaatctcggctatcacttggcctgacaggtctgctgctggtgccaggatgtctgggttttgaagcctggctccattacatacttcctgtgtgaccttgggcaacttactcaacctgtctgttcctcagtttccccagctgtattatgtcagcataatagtttgttgtgtgaattaaatgaggtaataactggaaatgcttcaaacatggttcctatcatgagaaatcctgctttccgcctaaatgtgctggaaaattcctggtggtgcagaacaggagaccagagcaaaggaaagacagggtgcagaagccaaaaattaccttggagaacaaagcgcatgttaaggttatttttggattctaggtttatctctgcttggtcttcagttacctacaagagatccatttaggggatttttgtttgtttttaacgatagctttattgagatataattcatatgccataaaagtcactcttttaaaatgtttccggtatattcacaaggctgtgcagccttccctgtccttgattccagtctgagtttttaactgaagggataaggaggaccacgctttccccagaccagaaccgcgggccagggggcgattccgctgagtcaccgcgggcgcctggtgcgcggcggcggagcccgggaccttccttggctgccccctagcgagggccgcagcgcagcctgagacacccgccggggccgctccacggccgtcggatttagactggaagctcggtccaggtccccagcttgatgcgcccgcggtgtaggagaccagcccgactcgagcttcccctgagcccctggactcttgactccagcagggcctgggtaatgaacgtcagctcccctttcccaaaggggttgctctgttgggaaggcacccgtttgatacagtagcatagagatgggttttagcatcaaaatatcagaattcaagccttgctctctgcttactagctgtgtgaccctaaaaaggtttctgaacgtctctgagcttcagtttcctcatcattccttctcacggggtggttgtgagcattacagagatcctctctgtgaagcccctgtgagtggctcatcctgagggctgaaataaacatgttattaataatccaaaactggcaagggatgttgactggtccccctcccttgcccaaggagctttctagaacctgagttatcattaccaaactgtactgccttgagtaagaaagttagaaggaatgggaaggatggtggcaggtggaggaaggcggattggtcatcacctccttgcagcaagaaacagccccagatcgtgggaaacctacagacctgctagacagactaggagcaaaagctggggctttaagaatccccagggaggttctcctgagagagtagccagttggattttgtaagcagagatttgtttggggaggaggtgacaacgtagggagcagaggggcaaagctgtcgggaatcctgccttgagggcagggatgtgtgttggggggagttgggtcactggggctcggtggccttgggcaagtttctacctctcaggtcctttacccacctagggtcgccatcctgcccacctcacaggttacagtgagcctggatgcactgtcatgggcaggtgcccaggaaaatggcagacatgttccaaacagcacgcagcattccccagtgatgcccagggtcaccttggaggtgggcgagatgcctggggtttctcgtccaccccacaacacctcaggggacagccaaagctgtcccttcaggtaagctgcacagaagatgtgaactctgctgcaaagactctattctttgggagcaaaagggacccagggtctcacctgcacatccctgtccctgagggcctaggggttcttggaggccccagccttggcaaaatgaggaagaaggtgaaggttgtctgggcccctgccaggctccttcctcggccacgcactccccttcctgcacacacacccttctccctccaccccatctccattgttgtcagaaaagtcacaataaaaaggtccatattgtctagttcccatacttttaatttttaaaattttatttatttatttatttatgtattttttgagacagagtcttaacccaggctggagttcagtggcatgatctaggctcactgcaacctctccctcctgggttcaagtgattctcatgcctcagcctcccgagtagctgagattacagatatgtgccactatgcccagctaatttttgtatttttagtagagacggggtttcaccatgttggccaggctggtctcgaactcctggcctcaagtgatctgcctgcctgagcctccggaagtgctgggatttcaggtgtgagccaccgcactcggctccacacttttcacttattaaaagactgtggtgtccatcaatggatgaatgaataaaccaatgtggactatccctcccattacccaaggaatgaagcacggagccgtgccaagatctggattcacagtgaaagaagccagtcaccaaaagccacgtgctgtgtgacttcccttatacgaaatatccagaagagatacatccatggtgacagaaagtagatgagcagctggggactggcgaaggggagaagggggagcagctgtctatgaggtccagcctttcttctgggtttggtgagaatgttttggaactagatagaggtgatagttgtacaacattgtgaatgtactaaatgccactgaatcattcattttaaatcgttctttacgttgcatgaattttaagtcaatcaaaaacagttgtttgaaaagagaaaagcctatgggtagcggcagcagtgattggatttatgattcgattccatggctcatccctcccctgcctcaccccctcgccctccgacgtcttcttcttttactctgaactgttatctttgttctcatctctctctctctctctcaaccctgcagacacttttccctttctttgtctgcccccaccctccagatttccgtgtctccagtgtctccctacgaggcatgaattgagactgggagggtgtgattctgaagaaggcaccaacagtgactcagctagccccttcccccaccccgccccccgggcctcaatttagctaaaaaaccacagggacggactcaggaggcaatacctttccaagggtccctaaaaaatgtcccattttagtgtccaggtttcactcaactttagtgcctcccctaaaatgtgttccttacctcccaccccactgcatctaagtcactgcctgagaaaacaggattgaggaaaggagaaaggaagagagagagagaggaggagagagagagagagggaggaaggctgatggatttagaaaagaagaaaacaagtggtctgaggaaaacagccttggtgtgtttattttcctgtctgtgtatcgcttctcggccttttggctaagatcaagtgtattttcctgtctgtgtgtctcgcttagattacagggatctgtgggtgatgacacgtctggtccaggctgcgtagtcacctcaagggcatgcttattgatgtgtttttcaattcactatctttgcatgggagtcccaggccaagaggcacagctgcgccatttgtctgttggtttagatatcctttatccagttcttccagagaaatcatcctgcccttctggaggaggtgggcagcaggggtcagagatgggagggaaaggaaggagccaggtccttggctaggatgccagggtcccctgcctctcacctggcctgggctggaggcctcctgctgtcctgtcactgatcactaccccgccccagcctcctgagttagaagacacaggctaaagtagagtatttcttcattgaaaaacccatacaaaataaaggttcataaaaaataaaaatttagactgggtgctgtggctcacacctgtgatcccagcactttgggaggccaaggcaggtggatcgcttgagccctggggttcatgaccagcctgggcaacatagtgaaaccccatctctacaaaaaatacaaaaaattagccaggcatggtggtgcatacctgtggtcccagcttctcagcctatggacccacatagaatacaatgtcagcataagaagggagccctggggtcaccaaatggtttgggcggcaaagaacctgaaggttgagagaagtggcttggttacccagctgttggatgtgagacctggccactgcttcttccataccctagacctgcaccctgacatctcaagtaaaaagttgggggatgttttatggtccaggatgaaggaagggcagtgaggggcagcggagcatcactttgcatttctgtctgcctcttactggctgtgtgacctggggcaggtaacttcccagactcctgggaatcataacacctatgatgatgatgatgatgatgatgatgatgatgatgacacctacctcaaggattgccctgaagggtcacagagatgcctgcaaggcacctgcatggagcaagcgccccttctctggcaggtgctgggtgagcactacctgctgccaggccctggggctatggcactgcgtgaccctgcaagtcctacctggcgaagctgtcgttcttgtgctcagtcagtgttggttgtaagactgagaagagtcacttcattttgctctccagggacatctttctgggtcctattttctgcctatgtcaagtagcgcctcaaggatgctcctgaaaatgggcttgtctttcttaacatggcaggtaggtcccaaagcattagcatggggcagctgacctagcccagccaatgcagtgcagtgactcttgcaaccgagtctaatcagaaggtccatgaacctacgagcatttcctgtcccaggatcagggtggaggctgagcctccctgcttagagattcttcccatgcattccacttttttccccaaaagaaaatattgacccttgagaggcacacagtttatttattttgcatagtaaatagtagcctgtattttaaggatgagttgatttctgcatcagcccctgtaggtcatcagccttctattggtgcatctgactctctctagccctgcagggatggtggagggggaggggaaggagggatctttattggaaaccaggacagtgagactcattgccctgtcatctgctctgtggtgctgaatgaggcagcccaacagagaaataccctgagcgagcatccccagcctccaaaacagtggcgcattgccctgagtcctgggaatgacctttgattctcctgctcctgacttggaacccatggaaacctctagaagcagctgaggaaaacccaacatgaaaagcagaactccacactgagaatataggaggtgatcggaacatacaatgattcttgctaagaccgattcacagtttttcttttttttcgatcgaagaaatactggagaagcctaaagaaggagtctaaaaactctggcacgtgggccaaaactgtccttgagctaagaatgattttcacatttttaagtggttgaaaaatgaaataaaataagatgatgttttgtgacacatgaaagctatgggaaattcaaattctaatatctataaatagtgttttatcagaacacagtcatgctcatttatttatgctcgatggctgctttcccgctacaattacgttgagcagttacaacagagaccacgtggcccacaaagccttacaatatttactatctggccctttccagaaaaaaatgtgccgactcttgaccttaacctcagcaatttgggaggccgaggcaggcggatcgcttgagctctggagttcatgaccagcctgggcaacatagtaagactccatctctacaaaaaatacaaaacattagccaggcatggtggtgcacacctgtggtcctagccactcgggagactgaggtgggaggatcgcctgagcccaggaagtcgaggctgcagtgagctgtgatggcaccactgcacctcagcctgggcgacagagcaagaccttgtctccaaataaataaataatgcaaagtaaaataaataaaaccatataaaaaggaatcaatttaaaattataatgaaagctggccgggcatggtggctcacgcctgtaatcccagcactttgggaggctgaggtgggtggatcacgaggccaggagatcgagaccatcttggctaacacggtgaaaccccgtctctactaaaaatacaaaaaaaaaattagccgggcacagtggcgggcgcctgtagtcccagctactcgggaggctgaggcaggagaatgtcttgaacccgggaggtggagcttgcagtgagccgagatcgtgccacttgcagtccagcctgggcgaaagagcgagactccgtctcaaaaacaaaaacaaaaacaaaaacaaaaaaaaattataatgaaagccaaggggcatagtagaacaaattttctagagctcattaagtcaaatgagtcaccagttagtaaaacgcagtcacggggaagagagggcaggattctttgaagcagcggctctcctaaaaacaacccacccttgtccagctgccttccctcctgagggtgttccctttgactgtgtgacccccatcccctatttcccaaccgtccaagcccacctctagcataatacgagcttttaatccctctccctgaccccaacccgattttgaagcccagtctagtattttctcaaatacacttcttggctccattccttcctttccatcacctctgccttttcactgcatgcttggaccactgcagtcagctccctatgaacagttgctctctacccatccaatcggccccgcctgctgctgccaaattcaccgagggcacctctgtggtgctgcctgtggacaaagtccaagccagccacctcacccacctacaggtgagtggggagcagccagcgtgtccagtggtttaccccatcgccacagacttggtgatgtgtcgatgtgcagagaaggggtgttggcagccacaacacaagcaaccccgccccatgtgagatctaagatgggcgtgctgggagccacctctgagaatccaacagaaggcagaggggagaacggctcacacggcacaaacactccttccttttttttttttctttttcctttttgaaaggagtctcactctattgcccaggcaggagtgcagtggtgcaatctcagctcactgcaacctccgcctcctaggttcaagcgattctccagcctcagcttcccaagtagctgggattacaggtacactccaccatgcccggctaatttttgtgtttttagtagagacggggtttccctatgttggccaggctggtcttgagctcctgacctcaggtgatctgcctgccttggcctcccaaagtgctgggattacaggtgtgagccatggggcctagcctccttccatttaaatgtatgcctaatttgcccattgagaacggctgagacgcattttaagtggccagggtctacttagagttagtgctcatgaccaggcccaggtcaagcctggctggccagatggtgcctttgacctgctctgtctctgtgcaaaggaatgagctgaaggatgggggtgcagtgtgtgggcagtgggctggggctggcaggactcagtgactaagggaagagaactttcctcactaccagcctgtcttttcagggcaccgcggggggctttgggacttggtgatgaacacagcacagagagctgtccagcatgcgggtccctggcttctcacacttcccaggctccttcagaggctctctccaaagggagctgctctctctagaacccatgaatttggaatataggcaaccactgcattggggaccactgacctcaaacatagagaccagagcaaatggggctcatcacgtgaaactcatctggaactctagcaggttcttttatatatatatatatatatatatattttttattattatactttaagttctagggtacatgtgcacaacatgcaggtttgttacatatgtatacatgtgccatgttggtgtgctgcacccattaattcatcatttacattaggtatatctcctaatgctatccctccccactccccccaccccacaacaggccccagtgtgtgatgttccccttcctgtgtccaagtgttctcattgttcaattcccacctacgagtgagaacatgctgtgtttggtttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttataacagcatgatttatattcctttggttatatacccagtaatgagatggctgggtcaaatggtatttctagttctagatccctgaggaatcgccacactgtcttccacaatggttgaactagtttacagtcctaccaacagtgtaaaagtgttcctatttctccacatcctctccagcagctgttgtttcctgactttttaatgatcgccattctaactggtgtgagatgttatctcatggtggttttgatttgcatttctctgatggccagtgatgatgagcattttttcacatgtctgttggcgaactctagcagcttcttttcacaagttcatggagagaggtttcccactgagggaatcacatctgtctgatcaaaagaggcttgggaaatggctctcctgttcattccctgaaaacctctgatggaaccactgccactgtggcagccccagcactggcaccccagccatgattggtgccccagccacatctctgctgtgagccccagagccctggttaattaatcatccacgtgttgatggggagaggcccattcacaaaagcgacataaagcccagggagacgtggccgtggcaagaagggtgtgggactacattccgcccccaactgagagattcagaaaccagaaaaaaatggaaaaacatactgtgctcttgggtgggaaaactaaatatcatgaagggagcaatttttatagttttggcctataatacaattccagccgaaatcccagtggaactttgagaatttgcaggaaaaaaaaaaatgtctaaagtacatctggaagacaaacttacaagaaggtcaaataattttgaaaaagaaaatgatatctaagcccacctagagaataagacttgagatccaaagctaaatcaggaggctctagcaaaattgacagataagcaggacagagtgcatggtgcattcacctggggaagagggcagattggtctacaaataggcctgggtccactgactttagctgttatatttggggagaaacttttcaacctcactccatcttaaacctaaaaatattccagatgaattaataaatataaaaaattagaccactaaaaatgtagaagaaaatggatgatctttctataccatagagcaatggaataaatcacaaaggaaaacagatttgactatataaaacttaaaccctgcccatcaaaaaccatcagaaaccaaaataaaaggcaaccaactggagaagatagttgccacaaatatgatcaagggttaatgttattcataaattaagagcccacacaagtcattagaataagcactgagacctgaacagacaagcaaaaagaatgagagtgggtcggcgcggcggctcatgcctgtaatcccagcactttggaaggctgaagcaggcggatcacttgatcccaggagttccaacaccagcctgagcaacatggtgaaaccctgcctctacaaaagtcataaatattagccgggtgtgatggcacacgcctgtagtcccagctactcaggaggctgaggtgggtggatcacttgagcccgggaggtagagtctgcagtgagccaagatcacaccgctgcactccagctggagcaacagagtgagaccctgacttaaaagaaaaaaaaaaaaaaagaggagaaaaatgctgatctcactagtaattaaaacatcaggccaggcgcagtggctcacacctttaatcccagcactctgggaggctgaggcaggcagatcacttgagatcaggagttctagaccagcttggccaacatggtgaaatcccgtctctacaaaaaatacaaaaattcgccaagcgtggtggcacatgcctgtgatcccagctactcgggaggctgagacaggagaattgcttgaacacgggaggcagaggttgcagtaagctgagatcgtaccattccagtccagcctgggctacagagcgagactctgtcccagaaaaaattaaaacatcacatatttaaacaactctaggatatcatttaaaaaaacattaatagactgttttttagagcacttttaggttcacagtgaaactgagtggaaggtacagagacttcccgtatgttccctgccctccacgtacagcctcccccactgccaacgtcctgcaccagagtggtacacttgttacaaccaatgaatcctcattaacatatcattatcacccaagttcatagtttacattagtaaaacatcatctttcatctataagcacaaaaattttttggcatttatttaggtgtatgattaactcagtgttgacaagactcacacttcatacccacttgcactgcatctgagaagcaattggtgtctacagccgctacaccctcaacaagcccgatcttgtttgaaaagcaattggtgatgcttctcaaaattctatggacaaagtcagccgggcatggtggctcatgcctgtaatccctaaactttgggaggccgaggcaggcagatcacctgaggtctggtgaaaccctgtctctactaaaaatgcaaaaattacccaggcatggtggctggggcctgtaatcccagctactcgggaggctgaggcaggagaatcgcttgaagcaaggaggcggaggtttcagtgagccaagattgcaccactgcactccagcctgggtgacaagagtgaaactccatctaaaaaaaaaaaattatggacaaagtttttcaaaaagatatttaatgcaactttatttgtaatattggaacatctgaggccatttcagtgctaactattaggggatggttaggaaaatatggtacatatgtggaaaggaacatttggtagttagtgcccctgatgtttacaaaggcttttagtgaccaacaaatgctcatgctataatcttatgtgaaaaaagcaagtagcataattgcaactatatttttaatgcatagaataaaaggctagaaggaaatatcacagatccttgacatacattcccaaacctttgtaaatccgcggattcatgaaaacagacacatttgcacaagtgcctgatcttttctgttatacattcattagaagtcaagccctggtgccacaaagtatctgccttttcaaatgtgatcagaatgttctcttttgcttcaaggccatttttcacgaagcagtggcatttttgcctcttcatcagagtcaccgtgtgccctggaggactgagaacagcagagccgttttaggatgggacagggcagccaggaggattgggctcactccctactgagtgcctcactcccgtacagcccccatagaggaagaggggttcaaatttattcctcagccagatggcatgtgccgcctgtcctggaatttcacatcacttatgatggaccaaaattccaaaagctgaatccatgattgtcaaagtctggtatggcaggatgtcaacagtaatcgtttctgggcagagggatgattttctcttcccatcttgctttgtataaatacattttctataataaggttgtattacttttctcatcaagaaatagcaaagtactgttttactcaaaatatgaatagagccaggcatggtggcagcttatgcctgtaatcccaacactttgagaggcggatatgggaggatcactttagcccaggagtttgagaccagcctgggcaacatagtgagacccccgtccccactcccccaaagaaaacccacaaagcatttatcctggattattcacaggggccaaaaaaaaaaaaaaattcaggcctcctatagccatgagctacgaatatgaaaatatgcaaatgtgtaagaaaagccagcacatccgatttttacttttactttcacacctctgtccaccatgttccaagagaagaaacttggtcattgaaaggaatagatcaaatccaaagaacaaaaccactgtgctcattaaacttcttagtgttcacaaagctttagctgcaggttgaatggggcaacccgaattggctggctcacctgggctgcagggagcagagatcgcgacactgcactccagcctgggcaacaaagcgagactctatctcaaaaaaaaaaaagttcataaattcaaagttatgaattatttttaaaataataataatttacaataaagatgaggacaaagtgtgagtaaatggtggtttctatccagctctgttgagctgaagtggcatctccctgctggggcttttggggaagaagggtgtgtgttgctcttcagatcccaagcctcatgcccctactgggccctgtggggtgcttctcagcccaccaggagagccaccgttggaacacacacgtgggggacctggtgggtgccggtgtggtgaatgggggccacagcctgactccaggaagccagcaaactcggagctggaggagtcaggacacccccgatgagtcaagagttggttttgctgccagttgacatctgattgaaccatctcttcacttctccgtgcctcactttccttaccagacaggctctgctgatgctgtccctctcctgttcagtcgtgccctcaccgttaaagagaaagagcaaactgctgggcagcagcattgatttttttaatgaagtggaaagagagctgggaataacaagtcgggcccacctcacctgcctcacctggtgggtttatttgttttgtttttttttttttgttttgagacagagtttcaccctgtcacccaggctggagtgcagtggtgtaatctcagctcactgcaacctccacctgccaggttcaattgattctcctgcctcagcctccccagtagctgggattacaggcacctgccacatgcctggctaattattgtatttttagtagagatggggttttaccatgttggccaggctggtctcgatctcctgacctcaggtgatccacccacctcggcctcccaaagtgctgagatcacaggcgtgagccaccatgcctggccgtcacctggtggtgttgaatatgaactgctgcggtgttggtaaattaagcaagcagatagatgtaaataacgcttgggcaggaatatggagcacgggatgaggatgggcggccaactgttagagagggtagcagggaggctgagatctgcctgccatgaactgggaggagaggctcctctctctcttcacccccactctgccccccaacactcctcagaacttatcctctcctcttctttccccaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaaggttagtggacagccatgcacagcaggcccagatcactgcaagccaaggggtggcgggaacagtttgcatccagaattgcaaagaaattttaaatacattattgtcttagactgtcagtaaagtaaagcctcattaatttgagtgggccaagataactcaagcagtgagataatggccagacacggtggctcacgcctgtaatcccagcactttggaaggcccaggcaggaggatcccttgaggccaggaatttgagaccggcctgggcaacatagcaagaccccgtctctaaaataatttaaaaattagccaggtgttgtggtgcatgtctatagtcctagctactcaggatgctgaggcagaaggatcacttgagcccaggagttcaaggttgcagtaagctgtgattataaaactgcactccagcctgagcaacagagcaagaccctgtcaaaaaaaaaagaaaagaaaaaagaaagaaagaaatttaccttgagttacccacatgagtgaatgtagggacagagattttagggccttaacaatctctcaaatacagggtactttttgaggcattagccacacctgttagcttataaatcagtggtattgattagcatgtaaaatatgtgactttaaacattgctttttatctcttacttagatcaggcctgagtggcctctctttagcaagagttggttagccctgggattcttactgtagccacattaataaacaacatcgacttctaaacattctataataccatcttttggccaaattgacttcgcctcttcctctctctttccaaatgaaatgtgtttcatttcactgtcagaccacatggttggggaccccacagagcacacagccctccctctgccttcccatgctggcccttcacccactgctggagtgccaggttggtccaagggttggaccaagttgtctgaggttgtctcaaggttggtcgaggctgtctccgcgctgggttgtgctacaaggagcccttctttccatgggtgtggctggcagtgagtgctcacagcaacagcccacagtgcagcccgagggcaggatggactcagtccctgcctccatacccatttctaaggaggcaaaatggcaaacactctacttttctcttttaatgctaaaaataagaaaacaccttgcagcccagggtatgggtagtgcatggaagccgtggagttgtgaggtgggaagtgacctctgctggatatgtctattcaggaagattgctggagtgggtggggtctctgggaggtcccctgagtgtgggaagctgggaccaccagctttctcgcacagggagtggccatcccagcttggagaggttccaggactggttgggaggcacgtttcagatttctatctgttgaatcagcgaagatattggattatgaggaatttgggaattaggaaagtgggtgcaggtgggttgggggtaggtgaaggaagacatgggcgtattgggggagcaggggctgctcagaggtgttccagaagctctgggtgaggaggtgagagggaccggggaatgcagctcggcccagcctccctgcctgaggtcagccatcacgtggtgatggcaagatggaaatgtgctttctgactgctccagccagtgctgccagattcagctccccagggagggcacctgagaggctccaagccaggagatctgttttctcctttgttttgtttttttttgttttgttttgttttattatactttaagttctagggtacatgtgcacaacgtgcaggtttgttacatatgtatacatgtgccatgttggtgtgctgcacccatcaacttgtcatttacattaggtatatctcctaatgctatccctcccccctccccccaccccctgttttctcctttgaatccttcttagaggccgggtgcggtggctcacgcctgtaatcccagcactttgggaggctgcggcaggaggattgcttgagcccaggagttccagaccagcctgggcaacatagtgagacctcgtctctacagataataattttaaaaattatccgggcatagtggcatgcacctatagtcccagctactcaagaggcagaggcaggaggatcacttgagcccaggaggcggaggttgccgtgagccaagatcccaccactgcactccagcctgggcgacagagacccccatgtcaaataataataataataaataaatccttctcagtcccttcctcactgtgtccccctccactgaatttttccacctcctctcccacttcccccactcccgctttccctctccttctctccccactccatctttttctttctctgctgtttctcgtccctccctcctctccatcccacaacactgcctaccctgtccctgccccaccctggtgctcaggatgtgtgaagtgaggggtggtagcccccaagacctcaaccccgaaggttagcctgttgaaaccactttctcccagctgcccccctggcagttggtgctgctgggggaaactgggattgggggccagattttgcctcttttcctgacaaagagagatgaagagttctctcaccaggtgcctgggactggggtgtgggtgtcccagcctatcccagcgcatctgttctgcatcatgattaatagtgctgctttcagccgggcgcggtggctcacacctgtaatcccagcactttgggaggctaaggtgggcagatcacaaggtcaggagttcgagaccagcctggccaacatggtgaaacctcgtctctactaaaaatacaaaaattaaccaggtgtggtggtgggtgcctgtagtcccagctacttgggaggctgaggcaggagaatcacttgaatctgggaagcagaggttgcagtgagccaagatcgtgccactgcactccagcctgggtgacagagcgagactccgtcctaaaaaaaaaggagttttgctctgtcgcccaggctggagtgtagtggcgccatctcggctcaccgcaacctgcgcctcccgggtgcaagcgattctcctgcctcagcctcccaagtagctaggattacaggcgcctaccaccacgcccggccagttcttgtatttttagaagagacggggtttcaccctgttggccaggctcgtctgggactcctgacctcaggtaatccgcccacctcagcctcccaaagtgctgggattgcaggcatgagccaccgtgcccagtcaactccttctcaaaaaaaaaaaaatagtgctgctttctctttcaagtgtcctgatttgggtgatagtaaatgccactctacttataagggatctacctcagaatgctaattgggacatttttgtagcactctactgttggcagcaggtgatgctcacaacagcccgtgagggtggatgacgtccgcttcacagatgacaaaggagcctcatgctcagaccgtgggctgccagagcaggtccatggctgcagccccacatggaccatatttcccccttgtcactctttccaccaagctcccttggaacttcagttattaagctctcttgggtggaatccaagttagaatcacaacatgtgcctcatatggattgtgccagtgaaaaatgacattctatttagaggcagggcagcctggcttagagtcagtttaaaatatgtattatgctgcaacaaatgtaccatgatcctgtaagatgttcacaacaagggaactggatgtggggtatactgtctgtactaacttcacaagttttctgtaaatctaaaactgttccaaaataacaagttcgtttaaaattaactccaggagaccaggtacggtagctaatgcctataatcccagcacttcggaaggctgaggcaggtggattgcttgagcccaggagtttgagacaagcctgggcaacatggtgaaatcctgtctctaaaaaaaatcacaaaaattagccaggtgtggtggcgcattcctgtagtcccagctacttgcggggctgaggtgggagaatcatctgagcccaggagtttgaggctgcagtgagctgtgattgtaccactgcactccaacctgggcaacagagcaagaccctgtctcaaaaaacaaaaatgaaataaagtccaggaaagaagtaggttttaccactcttattttctgaagagaaaactaaatttaatgtgtaaagtgaggacaagttcaccaagttagtgtttgagttgcctaaaatatgtttgctaaaactattcaaagctttcacataaaacatgatcagaagttctatgccaaaacatatgtgtgtgtatatatatatgcactatatatactgtatataaaaatgcaaaatctaaattgccaaccttttagaaattgctctgaaaggaaagcatttcaagataatttgcttacccaaagaatatactttccaagaaagcaagtaatacttaaggtgttcataatcctcatcaaattaattcttgctactgaaagcttacaaggagctgttttgatgtcgggtgtgacaggtttgacttggcagaaggtgtcactttactaacaacattttaaataagtgacagaagacaagaaactacacgttaaatgccagaacaaagagtgtctaagtggatgctaagagttgaaatatggctggatacctgcccaagagagctgaaaagtagatgaaagttggttacctataaactagtgcaccctaatgaattaaaaggtgttgatgagttaacttgttatgccttccagataagacatgcaaatggggcttcttcctccttcactacttccaagggatttaacaaggagaccaatgcaaatgataaggactgtagggctcaagctggggacagattggggaaagggggaccatcatgcccatatagatgtccctgtgccctggcagtcaaggctgctgaaaaataacaaaacccagaagtctgcgtgatgctgcctctccatttgtccaaagccttcttgcggcagtttgcaggcttttgcaaaagctccaggaccaaggagctatgttcatgctggaagcttgttcaggattagctgttctttgtgggatgggtgcagccagggccaggtgtccagggacagtgttttaacaaagggcatgaggtgtctgatctcacagtggaactccacttgcctttttttcatcttctcattctgcttcatgcacagaaccagccccatcctgaaactgactctaaattactcccgccccaggtggagtgcctttctcggagttcaacagagccttcctgtcgcccaagggacaactccactgaatgcccaagccacacccaaaacctaacaagtaaaaaccaaattctgtgctcccccatcctgggccattcctggtttctctactgctgttggtgataccaccatcagcttgtccatcatgaccctggccagttcctcccacaaccctccacagcacccagggacctcacctccattccatccgacacagatctcctcaccacaaaccttggttttgcaacagcagccatgagacctttacaccctccgcccttcatcctgtcccccactgaggccccagagccattccttaaagcagcgcgccacaaactataacccacaagccaattctggtacccagcctgttttgcacagccagtgaactgacaatgatcttttcatacagccagaaaaacaaaacaaaacaaaaaacaacaaaaaaaaaccccaccattctgagcatgtgacttccatgttcaagatgtctcatgttcagaaaggcccctggaaaaggaggaaggggagctgggcacaaagggagaccctctcagctgagctcctcccatccagacattttcctggacttcctatccaatgacttcccttagcttcttatcagccacccctgtctgcccaggaggctggaagatgtggccttttaactgggcacagctctgtcctctatcatatcagggctctgttcccaaggagggtagagagaatggacaccaggtggaccctcagcagtctgtgccacagagggagtgtttgcaatttccagactaaaagtccccatgtgcttgacggggtatgtgactacaacgtgatgcttgacttttcctcatatgaccagagccactttgtccatctggtacaatgtcagctatctgctaggggccctccaggattcccagtcaattccatatctgcatcaccaccattggcactaaataaaataaaatactcaagttcctgctggtgagcatgagcagtgctacactgggcccttcaaccaaggtgacatgataatgactgaaaataatcactgccacttattggggacgtctcatctgccaggcatggtacaaagtgctttaaataagcattcaacaatttcatgctgacagaagccctgtgagccagtggagctactactatgcccattatacaggggagaaaactgaggcagagagaggttaggtaattcgctcagcctcacacaaccaataggtggtggagccaggatttgggccccatctgcctgactctctagaggctctatcttccagtcttccagagttgagtctaagccatgaataggacaattagacagcagaggaaacccattcagccaccatgtgcatgaagagtaaggaatttctgtcatacagaggggagtgaattcactgagctgagagctgaggaaccattgatctgatggctgagacaccactgggaagactggagaggcttttctgggcatgcagtgccaggcacaggaggagctgagggaagatgactaagaggtactggcaaagaattcagaaattctgatggaagctttacatgttaccatcacatccatccatctatccacccatccatccacccatatcttcctccctccacccaatcatgcatacatccagtcatctatacaccacccacccacccatccatccatccatccatcccttcatccatcccatcatccatccaattatacatacatccaatcatatatctgtacataatccattcttccctcggttcatccatccatccattcatccatccatccacccatcccttccttcatccttcctatcatccatccaatcatatatctgtacataatccattcttccctcggttcatccatccatccattcatccatccatccacccatcccttccttcatccttcctatcatccatccaatcatacatatatccaatcatacatctgcacatcaccagctcatccatctatccatttatccatccatccttccttccatccatcattcatccatcatacatacatctaaccatacatctctacatcattcattcttccatcgattcatccaattatccatcattccttcctccatccatcccattatccatttgatcatacatatatcatctatacatcatccattcatccatccatccatccatccacccatatcttcatccaatcaatcatacatacatcgaatcatctacacatcacccatccatccatccatccattcatctatccacccatccatccatccatccatccattcatctatccacccatccatccatccatccatccatccatccatgtaaccatccagtcatatatccaattacacatccatccagttatacattcatacatgcatctaatcattcaattatacatacacacatccatataattctacatccaattatacctccatccaattacacattcatacacccacctaataaattattaattcatatatccatccatataattatacatcaattatacatccatctaatcattcagtaattcacccaccatccagtcatctatccaataatacattcatccaatcatccatccatccatccacccattcatccatccatccgtccgtccacccatcatggtatgagccatgatttaccacgatggtcccctgtggacagcccaggtggggcagaactgaagggaagcccagggctgcccccataaacatttgcctcctttacatggatgagaactagatccacatgtataaatcctcatgatttgaaggtgcttttaccaacattcactcatgggattctcccaggagctctaggaggaggcaggtagagttgaggtcatctcacgcattttacagatgaggaaacggaggccctgagaggcaggtccaaggccacctgaccagaaagaagtggaactgggacttgaacccagccatcttgccccttggtcccatgctctctagcctgtaactcctgcttcctggtggggcatctccaggaggaccctatcggctggccatgggcctgccctggagtcttttgctctgtgtggccatccttcctccctcaggagagtgtgtgctcccagagcacaggctgtatcttctgagcattttgtcccttcccagtacctagcactcagctctgtatacattgggctctcaagaattctcaaccttccagagtgtaaggccttgacctgctcagccctggatactgcatgatgcattgataagcccataaaataaccagggcagattgactcccagtggccaaagtgccacagggaagggacaattcagcccttctaggaggaggaggaggtagttttctcatttctattaaggcaacaaaagctgccttactaaggacattcttggtggagggcgtgactgtcaaccactgtgatcatttgggcctctcttgcccaggcttcccattctgaaaggacagttttattgtaggtacacatggctgccatttcaaatgtaactcacagcttgtccatcagtccttggaggtctttctatgaaaggagcttggtggcgtccaaacaccacccaatgtccacttagaagtaagcaccgtgtctgccctgagctgactccttttccaaggaaggggttggatcgctgagtgtttttccaggtgtctacttgttgttaattaatagcaatgacaaagcagaaggttcatgcgtagctcggctttctggtatttgctgcccgttgaccaatggaagataaacctttgcctcaggtggcaccactagctggttaagaggcactttgtcctttcacccaggagcaaacgcacatcacctgtgtcctcatctgatggccctggtgtggggcacagtcgtgttggcagggagggaggtggggttggtcccctttgtgggtttgttgcgaggccgtgttccagctgtttccacagggagcgattttcagctccacaggacactgctccccagttcctcctgagaacaaaagggggcgctggggagaggccaccgttctgagggctcactgtatgtgttccagaatctcccctgcagacccccactgaggacggatctgaggaaccgggctctgaaacctctgatgctaagagcactccaacagcggaaggtgggccccccttcagacgccccctccatgcctccagcctgtgcttagccgtgctttgagcctccctcctggctgcatctgctgctccccctggctgagagatgtgctcactccttcggtgctttgcaggacagcgtggtgggagctgagccttgcgtcgatgccttgcttgctggtgctgagtgtgggcaccttcatcccgtgtgtgctctggaggcagccacccttggacagtcccgcgcacagctccacaaagccccgctccatacgattgtcctcccacacccccttcaaaagccccctcctctctctttcttcaggggccagtaggtcccagagcagccatttggctgagggaaggggcaggtcagtggacatctgatcttggtttagtatccttcattttgggggctctgggtgtggcctgggcctctggactttggccacggtgtttgttccagcccttctcctaacctgtcctttccagacactcggcatctaggttattagcacctcgcatactttctgacatgctcctcagtcctgattttgaccatcttctcttgcttcccatctgtgtcagtcaagactgcatttggctgtaagaaacagaaaccccaactaactgtggcatttacatgaagaggtttacttttctcacataatcagatgtctagacttggccagcacctcaagggtcattgatgctctcctgtctttattttctgtcatctttagtggttggattgttgcctcatggttacaaagtggctgctgcacttccaggcatcacatctgcctttgaagcaggaacaagttgcaaagtaaagtggccaaaagggccctgaaactaaatgtgtccccttaggaaagcaggagttttcttgcaagtggcaatcttctgcttatgtctcattggccagagctgggtcttacggccaccccttgctgcgagcaaggctgggacattgagcattttgccgtccaacctctttagcagaataaaccaagggggaagaacgttaatagtggcttttgagtcactagttggcagtatctgcccctctatctttccatcctccccatggagtttcaaggttcctttctcagtacttcttcaggctctgcacgttcatttggatcttgtgtcttggggtgaaaaactggcccaagtgtctccccaagcatccacctttggattaatttggaaaatggctgtcaagtgcccgcctcttgcttggtataatgctacagctttagaggacgcagcaggcatgggccttgccgctgaggttcttagcctcatgagaatatccagatcagattctcttggctccttcttagagccagtgatgcaagacacttcctgctcatcttgtcgggacggttttacaagttgcctgccatcctgagaaagtctacaaaacgatgccagacctcatgccagcttcccaagccttgactctcagtgctccctcaacaggattctggaagaatctcccaaacaagtcgcaatcccctctggaccctgtgcaggcatgagactcaagagcattggctcccacccctggtggagggaacactgctggggctgggatcttgcctggttgctccgcctgcacccaagacaaccataattaaaatgtccttcattgaacttggaaagccttcaaagctgacaactccttatgtgtacccggaaaggcctgggagtgtgccagggcattgctcgggagggacgctgatttggaagcatttacctgatgagagactgacagcagctcctggtagccgagctttccctcctgcctctgctgtgaaggtggacccatccaacagtcaaatgcctgactctggacaggagcggacctatttattgccatgcaagggactctgcacttttgaattgtgggtcatgggcttggatttaggggttagagctgggagaagtcttggaagtcacctagagatgacactgccattttgcagatgaggaaaccgtccaatcaaaatggaccaaggacttgcccaaagcctcacagcaaaaccataggcccccgcactaaccccagagtccctgtgctgtcttaagaatcaaatagttgtaagcaatcatctggttttcagtatttcttcttttaaaatgcctggggccatgcccagcagtctgtttcactgcagcgtttacacagggctgccgggctttcctggtggatgagctgggcggttcatgagccagaaccactcagcagcatgtcagtgtgcttcctggggagctggtagcaggggctccgggccctacttcagggctgctttctggcatatggctgatcccctcctcactcctcctccctgcattgctcctgcgcaagaagcaaaggtgaggggctgggtatggctcgtcctggcccctctaaggtggatctcggtggtttctagatgtgacagcacccttagtggatgagggagctcccggcaagcaggctgccgcgcagccccacacggagatcccagaaggaaccacaggtgagggtaagccccagagacccccaggcagtcaaggccctgctgggtgccccagctgacctgtgacagaagtgagggagctttgcgtgtttatcctcctgtggggcaggaacatgggtggattctggctcctgggaatcttgggttgtgagtagctcgatgccttggtgctcagttacctccctggctgcctgccagcctctcagagcatttagggccttctggacttctagatgctcctcatcttgcctcagtcagcgcgtcagttccagagacttctctgcagggttttctggggcaggtggtggcagacccgtgccttcttgacacctgaggtcagtccaccctcctgctcagactgcccagcacagggtcacctcccaaggggtggaccccaagatcacctgagcgcacagagggtgcagatgactggaccacaccttttggtgatcttaatgaggtggtcccagaggagctcagacatgcaatctagcatccagttctgggactctgtctccttttcaaacgtattcatgtagaacaggcatgacgagaatgccttgtcaacatgggtgatggggaatcaatcagacagggcgccgggctcaaggctgcagtcacccaagagtggctcagcccaccaggccctaggaaacgcctgcacagcctggagctcctggagtcatttccttcatgtcttcttcactgcacttacgtaaagatgccagccattggtttggtgatttggagggtgcccagttgcccaacaagaaatgcagaagaggcctagccaggatttcaccagcagtggagagtagagaagatgtggccagaaaagagtttcctttccctcctaaagatggtactccctgcagctactggggaagcctgcagcattctctagggctctgtgtgttgagagcagccccaccctggccccttctgagtgcatttctgctttgtgacttgatccgtgaagtcccctgagatgggcagaggggatgtcctcgaagctggggcagagcctcatccttgaacgtgaaggacgtttgaagactgtggcatgatcacaggatgagatcacagggaacttgagtttctctcctcctctcccttcacagttatttcactgagggaaatccctcccctgcccagaatgaaaactctagccaactcttgacttttccatcactccaaagtagttgaaagtacattagtctccacagtggcaaaacagtgtgcaaaagctaaataattagaacagccagtcccatgtgacagtcaaagcttctaactccattcaaagttgcagccattcccctcgagggctggcagggaggggaggggtaagagaaacaggaaggttcttactgagttggtcctggtgtgagctgcgtcacactccctgcagaggtttcaaggagactctctctctctctgtctccatggggaccttatttgaattcttctactcttaccccagcctgccatctccagctatcctcccctgaagagcccttctgctgcgctggattctggtggccatgtcatctcctcggccccgtgggagtctgaagatctggctgcagcctcacctctgaggtcctgctagttgccacctcttaaacatgatctgaggctcccatgcactctgacctgtgcccacatggggcccacgggaaacacgctggcaagcaaactgtgggtgtgcagacggttctcagggctgcagcacctgtcctttgctctgcccccaaagcaaggccagcccatcttccatcctctagtgttccttggtggggccctgaccacagtccaccaggtccctaaccagaggggacacacaccaggtgtcctcaatgtattgccttgaaacagttgtgctgggactgtgatggggggtggccatgtagccacccccaccacccccaagccactctctccaaggaaatcctcctaaagatccctttacatcctccatgtggtggggaggttctagagttgggtgcatgtgtcttcagctactgacaatgcagaccttagttggcacctcgctctggcctatcctgtttgctgttcttggcgctccagtgaaactccccatgggccatccagttggggtgcagtgtggccacccccttgcaggttcctgccttgctggagagcacagggccctcctggctcttgtaaaacactccccatggtacagagaggccagcagtgatgtgaggcccaacctccctccatggtgttcccaagcagctccctttctggggtcaaggggtggcaaagacagtgcagcgtccaatttctgactcaagccgggcctggctatcgcagctctgcactgtgtgtgacagcaaggcaactcacccagtgccgtggcagtgaccgtgtccgaggaagcctcctcacaccctctgtctcaaggactctggcatttagctggacttgctgtagctctgagcctttctgccattgccatcaccttgtcagaaactcaggccgaatctgcactcagagttgtgcccaggcagttgagccaacacttgctcagcgatattgtcacatgacaaggcactgtcaccactgggcgtcgtgggtagcgcagtgtcggctggatggacccggagggtgtctgtgtcatgctagtgctagtgatgggagccccgtgagcccattgcccgccctcccatgccctcagcagctgcctggggacagccaatggcctgggtgtttctgaggctaccacatggcttccaggaaactcgagaacctttctctcccttgcctacactcttcacacaggcctgtgctggccagcggtggggatccggcattcctatcttaggtgcagaaagtgactgactcattgcaggcctgggagataagactgatggcccagccagcaagatgtatggatttctcagaggcagtggcctctgtcattgtcctcaggaaatgctggtgattctggtggcctgaggtcaatgcatgtcaacgtggccaacttgccttataaactttttttctggacaattgcgtgcactgtcctgtaacagtgtcctgttgtttatgatgcagaaataggtgtttttaaagcctattgattttggtactattaatgtggtcaggaactttctcagtctttcttgtttggggtgagctgtggcttcctaaacaggaacccaagacacccccaaaagctgctcaccagcactgccagcctccctcttaccaagtagcacccgttcaggacattctgcgaaaggcatttgcccagaagttgggaggaaggaaatgtaacattttggggcacctaccatatgccaggcaccaggctaaacgtgttcacacaaattctcttactaaccctcaccatccttctacaagacaaactagtatcttcatcttggggttcaagatgaggaaatggaggctcagagaggttgaatgaatgccggtgcctggatatgaaccccatctgcctgactccgcaacccaggcaaagtctttccttgaacttcccagcagccactgcttagacacagcctccacaaccatggctcagcagcaaattgcttctctgacctcactcagcctgtgtgtccttgttgagtgaggcattcaggaccctggtcccaaagtggagaaagtctttcctactaggtcatagctacacctgcatgtgggtgctgtgccttttgtttagtgaacttttatcaccagcatcctcagcaatgacatttgcagagaagccagagctgaggcaccttggtattcttgggatgtgactttcctgaatgtttaagggaaaatgcccgaaggtacagagagcttggtttctagtaaacaataactgtcttgcttttaccccccttcatttgctgacacatacaccagctgaagaagcaggcattggagacacccccagcctggaagacgaagctgctggtcacgtgacccaaggtcagtgaactggaattgcctgccatgacttgggggttggggggagggacatggggtgggctctgccctgaaaagatcatttggacctgagctctaattcacaagtccaggagattttagggagttggttcttatcaaaggttggctactcagatatagaaagagccctagtggtttttttctaataccatttctgggtaattcctaaggcatttagtgttctgaaagatgctagccttgtccagcctgggagttgagaatgaatgtctaacagaaactctaggccgggcgtggtggctcacgcctctaatcccagcactatgggagacccaggtgggcagatcacctgaggtcaggagtttgagaccagcctggccaacatgtgaaatcctgtctcactacaaataaaaaaattagccgggtgtggtggtaggtgcctataatcccagctactcaggaggctgaggcaggacaatcgctcgaacccaggaggtggacgttgcagtgagccgagatcgcatcattgcactccagcctgggcaacaaaagcaaaactccgtctcaaaaaaaaaaaagaaactcaaatatgtgtgacaggcgattctcactgcaggctgccctgtggctgatccaggagcaaggccttaaccatgtcatccccaagcgattgcttgtaaactttcttctgtgcagccttcaacccttattatgattttcttctcaggaaccaaactgctgtattcaagaaaggcagctttgtgtaatcatttatcataaatatcttaagaaaaatcctagagattcctaattttaggaaatgggagacctatggtactgatataatgtgggctgggcttgttttctgtcatttgctagataaatgaacttgagagcctactgtaaaatgtggaagcttctagattgcagaagggctggaaagacactgttcttttctcccgagtgatgggatctgtccagtatttagagctgcctctgaggccatctgattctaggagactctgcctcgttgaggatattttgaggcctaactacacattcctgcccccagagaggtcacagcctatagcaggctgatgtttctcatgtcacatggcacagaaaggcacattttcgttctcaggctaacaaagagcttcaaaaactattagaagggacagtggctataagagaagaacctcagtcaatgtgtgaaattaactaggaacctggctcctgtttcttttaggtcatgtttttcagcttaggtaaaactagaggctttgataaagcatgacctctagaaatcattgcttttcataaatggaagtgggtttgagttttttctactgattgttagtgcaggtgatgtctacatgcccccagaacatattccatgcaacaaaaaaagcccaggtcaccgtctttgctgggaacttgacttttgtgctcactgaattttaagctttctgacagcagcctggaatcatggagggataaagtacctattagtaagatggaaaaaggtgtttcaggttggagctgcagtctgttgagagtaagctatgggaaggcctgtatacgaggggtggacttttcttctgtaagtgtccagagaccaggcctcctgaagagggcatgggggcttaacttacctggactactgtgtttacaatactcatttatcttgaactcctcctaacccctgagaattgctacatttagtatttgctgagtacttcctagcatcctagggaatcaatagaacattctcccaaccaggctgggtgcggtggctcatgtctgtaatcccagcactttgggaggccaaggtaggcagatcccttgaggccaggagtgcaagactagcctggctgacatggtgaaaccccgtctttactaaaaatacaaaagttagccaggcatggtggtacacacctgtaatcccagctacatgggaggagtaggaggcaggagaattgcttgaacctgggaggtggaggttgctgtgagccgagatcatgccactgcactccagcctgggcgacagagtgagtgagactctgtttaaaaaaaaaaaaaaaaaagaacattctcctaacctggcttcttcctccaggggtgtaattaatcatgtcagtttcctcattgatacacacacacacacactacaatcctgtatccattacttttcaaggtacatttactatttacgtttggggtccttgtctcttttttaatagtgtttcttaaagtcttgtattatatcagagtacagtaacatcccagtcaagagcactctagtaagctctaggaggaaagcgacttccggaaggcagtggagacctgtcctgttggggcagcataggggcagcccctgcctctggtcagttctggcgctcaggctcagggttgcctctgggctgttcttcccagagactgacaaagggctcccataaggcacctgcagagcctgtgagaagctgaagtcaatgttttcctgacaccagttgatctgtgcaggatccattgatttaaccacctgctgtgtggcatgcactgtggtcgatgccaggaacaggaattggaggggcccatgagcatggccagtatcacaggctggaggtgctgctgcgctctgaccgggcctcttggggatgagcccatgtcaaccaccttgcctccgatggggtcgggcccacaggttacctttgtgtgtccatgaccacaccttcctccccgacctcatccaaatctctttcttttccaagcccctgaatccttcagggctgcaggttttgtttaaagcagagctggtgagttgcataggttgttgcgttgggactagatggggtgttcaaagagttgggagttaaaaaacataaagggtatttattaggagaaccaaggagtgtaattctcctgttcttaatatgcggccaggttaatgaatgtcacgtgaatgaaccagaaaaaaatgaagtgtgcccttgatcagctgggttggtgtgcagcaagctgtgtgaccaggggacagcagtggtcctgagggccgtcactgtctgccgtgcagagcccttcctcccacgggggcctacctcacctgtgccaagggcttgtctgtggtcagtgacctggatagatctgaatggggcttctttttcgaggagtcttatggcaggtctctcagtaaagactccattcttgatgatcacacattttggattttccaaatctgtcagagaatgggcttgaggcggggtttgtgggcactagtttcactggtttcatttaccaaaaaggggagcagaagtcaagtatggtggctcatccctgtaatcccagaggcaagagaattgcttgagcccaggagttcgagaccagcctgagcaacataaggagaccccgtctccacaaaaatgaaaaataacattttagtcagacgtggtggcatgcatctgtggtcccagctgcttgggagggtgagatgggagggttgtttgagccctggagttaaagttgcaatgagctgtgattgcaccactgcactctagcctgggtgacagaacgagaccctgtctcaaaaaaaaaaaaaaagaaagaaaaaaaggaaaaaaaaaactcatgcctgtaatcccagcactttggggaccggggtgggcagatcacgaggtcaggagatcaagactatcctagccaacatggtgaaaccccgtttctactaaaaatacaaaaattagccaggtgtggtggcacgtgcctgtaatcccagttactcgggaggctgaggcaggagaatcgcttgaaccagggagtcagaggttgcagtgagctgagatcgtgccactgtactccagcctgggcgacagagtgagactctgtctcaaaccaaaaaaaaggggtggggggcgggggcaggagaacagtgagaggtagggagaggaaaggggattctcgctacacccaaaccagataccatctagaggctagaatctttgggaggctcaaattccctagaaagcaggagaagcttctgtagccctcccgctttcccagtagattaagcccagggcggctccagatgtgtgacatgctctgtgcccaaccagagcccatcataggcagaggaataacacccacaccagaagggccctcggaggtcaccacgtccaagaaccctctttacagatgaggaaactgaggcccagagaggggagagccacctagcgagctggtggcggctagaccaggagagctgtcattccaagcaagcaaaggcaacgagacgagcccagagctgtgctcccatctctttgttagggggcctgggatgccctctcagtgtcattttgtccaggatgatgctccctctcttaagcgattaatgcgcccttgctaaccttttgctatcgctgcctcttcaaaccagaggagttgagagttccgggccggcagaggaaggcgcctgaaaggcccctggccaatgagattagcgcccacgtccagcctggaccctgcggagaggcctctggggtctctgggccgtgcctcggggagaaagagccagaagctcccgtcccgctgaccgcgagccttcctcagcaccgtcccgtttgcccagcgcctcctccaacaggaggccctcaggagccctccctggagtggggacaaaaaggcggggactgggccgagaagggtccggcctttccgaagcccgccaccactgcgtatctccacacagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaaggtctgtgtcttgagcttcttcgctccttccctggggacctcccaggcctcccaggctgcgggcactgccactgagcttccaggcctcccgactcctgctgcttctgacgttcctaggacgccactaaatcgacacctgggtgcagctgctccactccctcggcctcctcccgtgctcaggctgtggccgcacgcgcccctcacgcttgcccgccactctgcatgtcaccagcacccccgctccgtgctccccaccttgtttgactctctggccacttgatttgtccacaacggcccatcagcccacaggaggtttggtgggtgccttccaccgacaggatgacgggtgccctcatggtgtctagaactctccaaccctcccatgtaggcataagcagccccactttgcagatgaggaaacggaggctcagagaagtacagtaacttgccgaaggccaatgagtagtaagtgacagagccaggtttgggatccaggtaggttgtctctgaaagacacgcctgtcctgcatcccacaacgcctcccaggaggtgctggagtgtggacgcctaacacagagatgtgcagggcacacacagcaggtgacacacacagcatccagaggtggcccagagctcatgctgtgcctttggcccagtgccctgcccccacccactctgccttgtggcaggaagacaaggagcagacacaagatctccctggtccacatgccaccacctccctctgcagaggacaaggggatcctcatgctggcattggagggggttgagcagggcccaccttgagccctcaggagcacgaccacagcagccctgcagggagggattggtgggaggagagtcccaagtatcagggagaggagagttggtgtcccacaggagacctcagagccacaaggcgagcttgttcataaatttgggacccttagcatttcacagttatttgcagagcccagaaatggatgttactgaagctcacagttgcaagcatctgttaaatttttattagattttacttttagggaaaactttgaaatgctataaagaagcctgtgtttaaaagttaagacagaggctgggggcgatggctcacgcctgtaatctcagcactttgggaggccaaggcaggtggatcatttgaggttaggagttcgagaccagcctggccaacatggtgagaccctgtctctactaaaattacaaaaaattagctgggcgtggtggcgggcacctgtagtcccagctactggggaggctgaagcaggataagtgcttgaacccaggaggcggaggttacagtgagccaagatcacaccactgtaccctaagcctgggcgacagagtgagactctgtctcaaaaaataaaataaaataaagttaagagagaaaaaaatatatcctatatcctttgttaaattccaaaacagtaggggacaaataactgacttgacaggttactacaatatttcctgaaatgatgttttcttgaatactggcctactagaggttcataggtgtgtttggattaaaaaagagttccatggcccagtgactgggggaaaaaaataaaagactaaagtaagttaaacaggcttttctgctgcaggacttgtcagagcctttaatgtactaatggccattgtgaccctctgagaaggtcacagagtgggtttcccaaacttacttgattctacctgctaacatttcctggaggaagtttgggaaatgccgatttagcagattcttttgttgtgccgtggatggtgctggttgatgtgggcaaaacaaagaacacgtgagtcagatccgcctggggctcttactaaagtgcaggttcccaggtgccactttaggcttacagacccagttgtggggtaagcctgggagtcttttagcaggtgattctgccacatagtatagttggaaaacctctgggcatactcattgctggtccctctagaaatccaggtgacaatagccaatgagaagctccaagagacccagttgtccatggggtagagggaatgtgatattgaaaccaaagaagaaaatctatgatcagttttcagcagtgactgtcaagagaaggagaagggtgagttagcgctgatgctggctgacaggtcagcgggttggtttcaccaaggagtgtgatgaaggctgatgttgtctgtgggaatgtatgatggtaactggtttgtagctaatttggggaagcagtgagaattcgtgccctttgaagaccagtaagtggcaagaaacccaccaggcctggctcagggctgggctgggcttggctcgtctcagagcagctggggctggtggccaaagccaccattagtgaggggcaggccctgggggtacaaccagcaactaggggacaaagacaaccctgccagcctctcctattctggaggcgtgtgaccagaaatggagatgggttggtcagcataagatggccaggaaggtggaaatcaggactgctggcaatctagccacatgggcaggggagccgggtggttccaggcagtttccaaggccaagagggtgagcaggcacctcacagggaatcagggccaagcctggctgcagtgtggagacaatgcacccacccccatccttggatcttgcaggaggctgggtcctcactgagctaccaacatccatggccctgaggcttttaaaacacccatccatggagtggggctggtcccagtggggtgaggctgaccctggcagaaacagggcaggagcctgtgggttagggagactgcaccttccttagatagcctccatgccatcatgtccccgtgacagtttctgctgcgtcccctctgcatggtcccaccctcggccagcctgctgccccctcttgccaggttgcgctaatcagtgaccccagtgtgctgtgttgatactaacaatgcgaggcctagcagattcaagggaaaagagaaccaactgggtttccaccagacccaactaaacaaacatggacctatcccagagaaatccagcttcaccacagctggctttctgtgaacagtgaaaatggagtgtgacaagcattcttattttatattttatcagctcgcatggtcagtaaaagcaaagacgggactggaagcgatgacaaaaaagccaaggtaagctgacgatgccacggagctctgcagctggtcaagtttacagagaagctgtgctttatgtctgattcattctcatatataatgtggggagtatttgtcactaaagtacagctgtcatttaaagtgctttgtattttggggcaggcttttaaaaagtccagcatttattagttttgatacttaccccagggaagagcagttggcaggttcatgaagtcatgctcctaattccagctttcttagtgtactttcagtgagaccctgacagtaaatgaaggtgtgtttgaaaaccaaacccaggacagtaaatgaaggtgtgtttgaaaaccagccctaggacagtaaatgaagccatcttctcactgcataaactgcacccagatctttgcccatccttctcagtatttcacttcacccattgtttactgtctcaatgactggggaaatgtctggggaaatgctcccgtaattgcacagtggcgtttttcctggaaaatcccaccatggctctagataagacctatttttcttaaaggtatctaaaatttccagcataaattctgtctgaaacacctgaattttaatcagtactggagcccggagggcatctccagttgccacatagctctgagcattcagtggtgtgttgagggctgctcccggaagtgcctgcagagtcagggctccccagcctcatctagtgaggcagtggaagggcctgtggggatttggagagctggcctgggtctctgaagtgatagtgacagctgcttgtcaatcacggtgcacatttagtgccgggggcagggggcagggaataccagcctcatgcatgcatgcattcatttgttccttccttcattcattcattcagtacacatgggtacaacatccctgccctggagttgcccagagtctagggaggggaaagatctattaccctgggcctcggccagctggggagtgctgctggtggagaggggccgtgtgcagcgagggaaggaggagtcgtcaatacccccaccccagctttgctttcttgtcatcagccccagggccccagcctgtgtccctcctctcccattgctacttcatctcctgggtcctccttaccaagcctgaccacacagagggccttggccgcttccatggggaattggaaagcaataagatagcatcccctagaagcccagtgaagtctgggacaggacccttctctgagctctgacttgctcttggaaacacttcgaggcttagcctccccactttgtttcccaagagtgtgacctgttcccctccaaacacccccttctcctccagggccatgcccacccgtcaaaatcccccacgggcaggacgaactgtgggtgtcagtcaccatctatcctgcatcctggttccagggccccccccagccccgcctccatagggacaggcgtgcagacacccgtccctggctgcttcctcttgtggaatgggttcaaaagtaagcagtgttgtttacactgacaaactgaaaaaaaaagaaaaagagataacattggaggcttggcacagtggctcatgcctgtaatcccagcactttgggaggctaaggtgggaggatgtccccagcccaagagttctagaccagcctgggcaacatagcaagaccccatctcaaaaaaaaaatttaattggccaggcagaggtgggaggatcacttgaacccaaagggtggaggctgcagtgagccgtgatggcaccactgcactccagccagggcaacagagggagaccctgtctctaaaacaaacaaacaaacaaacaaacaaaagagttaacattggccagattaggattcaccagatagtgttaatattagtttgatttgagactttaatcagaaagcacatgtgtggtgggggtgggtgtaacctaagtcaggtagaatctttccaacttggggggggcacactcctgattgtagccatatgagtctgtcagtgtggtggaagagaccatgggttaatgggcaggtaaaaaagcaccttgcctggaattgagtagaaagtaaggcccttcagaccccgtgacacacttggggacattttcttgagtaacatcctaagattcatgtaccttgatgatctccatcaacttactcatgtgaagcacctttaaaccagtcgtctccaaattcaggggcacagtaacatccaacaggctggagaaagaacgtactagaacttccattcctttttcatgtcctcttctaaaagctttgtcagggccaggcgcggtggctcacgcctgtaatcccagcactttgggaggccgagacgggtggatcacgaggtcaggagatcgagaccatcctggctaacacagtgaaaccccatctctactaaaaatacaaaaaaacgagccgggcgtggtggtgggcgcctgtagtcccagctactcgggaggctgaggcaggagaatggcgtgaacccaggaggcagagcttgcagtgagccgagattgcaccactgcagtccagcctgggcgacagagcgagactccgtctcaaaaaagaaaaagaaaaagaaaaagaactgtgattggggaggacggtcactttcctgttcttactgatcagaagggatattaagggtacctgattcaaacagcctggagatcactgctttcaaccattacctgccttatttatttttagttactgtccttttttcagtttgtttccctcctccatgtgctgacttttattttgattttatttatgtttatgtttaagacatccacacgttcctctgctaaaaccttgaaaaataggccttgccttagccccaaacaccccactcctggtagctcagaccctctgatccaaccctccagccctgctgtgtgcccagagccaccttcctctcctaaacacgtctcttctgtcacttcccgaactggcagttctggagcaaaggagatgaaactcaaggtaaggaaaccacctttgaaaagaaccaggctgctctgctgtggtttgcaaatgtggggtttgtttatttgttttttagcctcaaagacctttcttcaaatgagttctggcatagaagcaccgtgtaaaatagttagaattctgggcaaaggggaaaagagagctgggggccatccctctcagcaccccacaggctctcatagcagcagctcctaagacacctggtgggaccttggtttcgaaatcgctactctaaggctgggcacggtggctcacacctgtaatcccagctctttaggaggccgaggagggtggatcacctgagatcaggagttcgagaccagcctggctaacatggcaaaaccctgtctctactaaaaatacaaaaattagccgggcgtggtgttatgcgtggtggtaatcgcagctactcgggaggctgaggcacaaggattgcttgaaccccagaggcagaggttgtagttagctccagcttgggcgacagagcaagaccctgtcgcaaaaattgtttaaaaaacaaacccaaaattgctactctcattgggttcctttgcccattcctgattttggcaagagaaatgcttccagattgccctgatctgggtaggacagcatcacgccatagcaacactgccccgtgagctcactgccccctcaactagcttgtggtccttggttaatgtcagtttcttttttgagtttgtgttatgtctaagggtcatctgctgggtaacggaacccagggactgccctagtccctagactgtgccatgcccgactctgccagctttgtcagtgatgctggtgctcgcctcctcgggtgctcgcctggtctgagcacacccaaggagttcttgaggccttagggttgtttgcgagagaatgaaagaacacgacctagctctctttagcatccttggtcaggttcaacactgcccccaggggcctctggtggagccaaccaccatcagccaaataaatccataattagagtcagaaaatggatgtctgcatatgtgtagtgcactaatgtcctgccgatgattgacatggagtggagagtgacctgatcattgctgtgagctctgctggccttggcacaactcatgctgataactaatgcacacagttcctctgggaggaaatgtcctcagggaacttggagtttgggtggggatgtgggtttgtgtgcccagcaagcccttgtggttgtagcagacactagtggcatctaggaggcaaagggtcaccccagtcttagccacgttttgagtcaaggtggcggagtggggctggtgttgactcttggtggcagtaacttttcccaatggtgaaaaacccctctatcatgtttcatttacagggggctgatggtaaaacgaagatcgccacaccgcggggagcagcccctccaggccagaagggccaggccaacgccaccaggattccagcaaaaaccccgcccgctccaaagacaccacccagctctggtaagaagaacgttctcttgaatcttagaggaagctgaagctctcagaggtacagccttcattttaggaggccttaggccactgagaatgaataacccctggcagctggtcagcagcttgcagtttactaagcactggagtcttcattgccttctcagtccttttgatttctgaggcaaatgttgaatccctacctttttttttttttttcttttgagacagagtttcgcttttgttatccaggccggagtgcagtggtgtgatctcagctcactgcatcctccacctcccaggttcaagcgattctcctacctcagcctccctagtagctgggattacaggcacctgccactatgcccggctaattttttgtatttttagtagagacagggtttcaccatgttggccaggctggtctcgaacgcctgacctcaggtgatccacctgcctcggcctcccaaagtgctgggattacaggcatgagccaccactcccagcctgaatcctcactttttatcaatgaagaaattgaggctgattctgcagcatgataaaaaaaaatacagaaaaaggaaaaaaaagaaagaaatcgagcctctgagagtttgcttgactgagtctaaccagctcattttaaacccgaggaaaatgcagtcacatgactactaagtggcagctctcggagcctctctggccccaagtccagggttccatagaggcagccccagcatggcatgttttcagtccccaaatgagactctggagacaaatgtctctggagacagagcagcagcctggataagtcacaatgggtgacgtcactcagggctcaacccctgggcagcttaacttgctagggacgttaggagtctgctgcaaaacctgagggtcttagctgagcagtcacaggctgggcccgttgccctgggctcctgtgagtaaaacccagtcaattttgagtacccagtaaggcatccattgagttattttgcagccaggagtgctattaagaacagtcgcggctgggcgtggtggctcatgcctgtaatcccagcactttgggaggccaaggtgggcggatcacctgaggtcaggagttcgagaccagcttggccaacatggcaaaaccccgtctctaataaaaatacaaaataattagctgggcgtggtggcgggcgcctgtaatcccagcttctcaggagggtgaggaaggagaatcacttgaacccaggaggcagaggttgcagtgagctgagatcgcaccattgcactccagcctggatgacaaaagtgagattccttctcaaaaaaaaaaaaaaaaaaacagtcgtcctctttggggattagggacagcctgcctgcctgcccgagcacttctctcttccattgccccagtgaagtattccaggcccctgggtttagactctgcaccatgtaggggtgtctgacctgcacttgctccttggtggcacgggcagcctatggcacttgctgcgggctgtgaccaaagcctggcctggatcttggatcttggtgactctgcttctccctggcctgagggagctgcccagagcctgcccaccacctgctgcgtgtctttgcggtggcatttctcgcacacatgccgtgcggtggcacccccaaggatggccattcactaaggcccattgtttttgtcttttcgcttcgtgttttctggcctggtgtttttctcatatacatgtgatccagggataattcccagaattttgacaggattttaagtagcgtttggatcctgctgtttttttttcacttaacatcgggccagttgactcacactctgttttttgttgttgtttttttgagacggagtctcactgtgtcacccaggctgaagtgcagtggcacaatcttggcatactgcaacctctgcttcccaaattcaagcagttttcctgcctcagcctcctgagtagctgggactacaggcacaggccaccacgccctgctaatttttgtatttttagtaaagacagggtttcaccattttggccagcctagtctcgaactcctgacctcaagtgatccgcccacctcggcctcccaaagtgctgggattacaggggactcacactttgtaacaacctgaaacaacgtgatgcatttccctttgggtcttacctgctcttcggtggctgcctgcaggtggagagaccctcccccttgggcccctcgaccttgtttcagaatggggcccctgctgggccagctgtgggtgcctgccacgtgaaggactcattaaggccctgtttaagcctgatgataataaggctttcgtggatttttctctttaagcgactaagcaagtccagagaagaccaccccctgcagggcccagatctgagagaggtactcgggagcctacttcgctgggagcagcctccctttgcgtgtgtggccattcactggcttgtgtttctagagccgggaggacccttttctgcaatgcagggttcacacagggttcgcagcctgaagatggagcagtccgaattctcttccctgtgcagtttgcgcagctgtgtttgtctgatgggctttctaatcctgtgtgctctccttgacttcagggacaatggcattacaggcatgagccaccatgcctggctgtctccctatgtttcagatgaagacataggcttaaggaggtcaggtgacttgcccacgaccactctgtaaataagaggcatgaaaagtatttggagccaccaccaccaagcccactggtcaccctgggtctctgaagtcagggaggcaggaggatgggaggtctgaggaggcagagaggctgagcctggaggccctggaggccgaggccccatctgttgtttccttatgtggaaaataagaggcttcatttgtcctattgccacagagcgtactacttcaggaacatccaagacatggaaatccgcagggcacggtggctcacgtctataatcccggcactttgggaggttgaggtgggagaatcgcttgaggccagaagttcaagaccagcctgagcaacatagtcagaccccgtctctataaaaaacattatttttaaaaaagacatggaagtcaaattctaaaaactggtgctggctgggtgcggtggctcatgcctataatcccagcactttgggaggccgaggcgggtggatcacctgaggtcaggagttcaagaccagcctggccaacatggtaaaacctctactaaagaaatctttactgaaaatacaaaaatccagtctctactaaaataagtctctactaaaaatacaaaaattagccaggcgtggtgctgcacacctgtaatatcagctactcgggaggctgaggcaggagactcgcttgatcccatgcagcggaggttgcagtgagccgagatcacgccattgcactccagcctgggcatcagaataagactccgtctcaaaaaaaaaaccacaaaaaaacaaaacaacaacaaaagaaaactagtgcttattcgtcactggccaagctgcccattggctacatgggtgcttcaaagagctgcccttctccaggtctggccagcaggtatgtgttacagcaaatgcctggggcagcggcaggggcattgctgcgggaagcttctggacttgcaggaaagctaagttctcagactgcaggggagctaagcacacctcggcacagggtgaggcctgcggttctcagacttcagtctttgtggagcttgagaaaaatgaggctttgcaggtcccacccctagagattctgctctatccactcttgaaggggatcgagaaatttgcattttgcaactcccactttcctccttgaaagctccggagattctgacgcagggttccgtgggccacactttggaaaatacagacccatgagatagaataccagactgttgaagtgtaacgggggcctgggaagtgcagtaacagaagcaagtttgagggtaaaggacacccagaggagggagggacagcatctgcatggagaggagaagagaccccccagcagcttccagggtgttggaagggtgcgctagtaactgctatgcatggcaggtggggaactgtacgtcagggcacagcagcatgaagcggtatggctcgtgtggacagctagggacaggcaggcgtggagcaggcatcctgttctgaaggccaaatcccacagaggagccagggtgctggcaggagccctgaactagccgaacagctgaacagctgaacattcaccctgtggggaaagggtcagaagcgtccaggcttgagggcacagctgggtctcgtcactgcatcacccttatttaggataaaggccctgaagaattgtattagaggttggcaaagcatatctaccacctcctggagccacgctggccgcagggattataattatttccattttcaaattaaggcctctgagctcagagaggggaagttacttgtctgaggccacacagcttgttggagcccatctcttgacccaaagactgtggagccgagttggccacctctctgggagcgggtattggatggtggttgatggttttccattgctttcctgggaaaggggtgtctctgtccctaagcaaaaaggcagggaggaagagatgcttccccagggcagccgtctgctgtagctgcgcttccaacctggcttccacctgcctaacccagtggtgagcctgggaatggacccacgggacaggcagcccccagggccttttctgaccccacccactcgagtcctggcttcactcccttccttccttcccaggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgagagtggctggctgcgcgtggaggtgtggggggctgcgcctggaggggtagggctgtgcctggaagggtagggctgcgcctggaggtgcgcggttgagcgtggagtcgtgggactgtgcatggaggtgtggggctccccgcacctgagcacccccgcataacaccccagtcccctctggaccctcttcaaggaagttcagttctttattgggctctccactacactgtgagtgccctcctcaggcgagagaacgttctggctcttctcttgccccttcagcccctgttaatcggacagagatggcagggctgtgtctccacggccggaggctctcatagtcagggcacccacagcggttccccacctgccttctgggcagaatacactgccacccataggtcagcatctccactcgtgggccatctgcttaggttgggttcctctggattctggggagattgggggttctgttttgatcagctgattcttctgggagcaagtgggtgctcgcgagctctccagcttcctaaaggtggagaagcacagacttcgggggcctggcctggatccctttccccattcctgtccctgtgcccctcgtctgggtgcgttagggctgacatacaaagcaccacagtgaaagaacagcagtatgcctcctcactagccaggtgtgggcgggtgggtttcttccaaggcctctctgtggccgtgggtagccacctctgtcctgcaccgctgcagtcttccctctgtgtgtgctcctggtagctctgcgcatgctcatcttcttataagaacaccatggcagctgggcgtagtggctcacgcctataatcccagcactttgggaggctgaggcaggcagatcacgaggtcaggagttcgagaccaacctgaccaacagggtgaaacctcgtctctactaaaaatacaaaaatacctgggcgtggtggtggtgcgcgcctataatcccagctactcaggaggctgaggcaggagaatcgcttgaacccaggaggcagaggttgcagtgagccgagatagtgccactgcactccagtttgagcaacagagcgagactctgtctcaaaacaaaataaaacaaaccaaaaaaacccaccatggcttagggcccagcctgatgacctcatttttcacttagtcacctctctaaaggccctgtctccaaatagagtcacattctaaggtacgggggtgttggggaggggggttagggcttcaacatgtgaatttgcggggaccacaattcagcccaggaccccgctcccgccacccagcactggggagctggggaagggtgaagaggaggctgggggtgagaaggaccacagctcactctgaggctgcagatgtgctgggccttctgggcactgggcctcggggagctagggggctttctggaaccctgggcctgcgtgtcagcttgcctcccccacgcaggcgctctccacaccattgaagttcttatcacttgggtctgagcctggggcatttggacggagggtggccaccagtgcacatgggcaccttgcctcaaaccctgccacctccccccacccaggatcccccctgcccccgaacaagcttgtgagtgcagtgtcacatcccatcgggatggaaatggacggtcgggttaaaagggacgcatgtgtagaccctgcctctgtgcatcaggcctcttttgagagtccctgcgtgccaggcggtgcacagaggtggagaagactcggctgtgccccagagcacctcctctcatcgaggaaaggacagacagtggctcccctgtggctgtggggacaagggcagagctccctggaacacaggagggagggaaggaagagaacatctcagaatctccctcctgatggcaaacgatccgggttaaattaaggtccggccttttcctgctcaggcatgtggagcttgtagtggaagaggctctctggaccctcatccaccacagtggcctggttagagaccttggggaaataactcacaggtgacccagggcctctgtcctgtaccgcagctgagggaaactgtcctgcgcttccactggggacaatgcgctccctcgtctccagactttccagtcctcattcggttctcgaaagtcgcctccagaagccccatcttgggaccaccgtgactttcattctccagggtgcctggccttggtgctgcccaagaccccagaggggccctcactggcctttcctgccttttctcccattgcccacccatgcacccccatcctgctccagcacccagactgccatccaggatctcctcaagtcacataacaagcagcacccacaaggtgctcccttccccctagcctgaatctgctgctccccgtctggggttccccgcccatgcacctctgggggcccctgggttctgccataccctgccctgtgtcccatggtggggaatgtccttctctccttatctcttcccttcccttaaatccaagttcagttgccatctcctccaggaagtcttcctggattcccctctctcttcttaaagcccctgtaaactctgaccacactgagcatgtgtctgctgctccctagtctgggccatgagtgagggtggaggccaagtctcatgcatttttgcagcccccacaagactgtgcaggtggccggccctcattgaatgcggggttaatttaactcagcctctgtgtgagtggatgattcaggttgccagagacagaaccctcagcttagcatgggaagtagcttccctgttgaccctgagttcatctgaggttggcttggaaggtgtgggcaccatttggcccagttcttacagctctgaagagagcagcaggaatggggctgagcagggaagacaactttccattgaaggcccctttcagggccagaactgtccctcccaccctgcagctgccctgcctctgcccatgaggggtgagagtcaggcgacctcatgccaagtgtagaaaggggcagacgggagccccaggttatgacgtcaccatgctgggtggaggcagcacgtccaaatctactaaagggttaaaggagaaagggtgacttgacttttcttgagatattttgggggacgaagtgtggaaaagtggcagaggacacagtcacagcctcccttaaatgccaggaaagcctagaaaaattgtctgaaactaaacctcagccataacaaagaccaacacatgaatctccaggaaaaaagaaaaagaaaaatgtcatacagggtccatgcacaagagcctttaaaatgacccgctgaagggtgtcaggcctcctcctcctggactggcctgaaggctccacgagcttttgctgagacctttgggtccctgtggcctcatgtagtacccagtatgcagtaagtgctcaataaatgtttggctacaaaagaggcaaagctggcggagtctgaagaatccctcaaccgtgccggaacagatgctaacaccaaagggaaaagagcaggagccaagtcacgtttgggaacctgcagaggctgaaaactgccgcagattgctgcaaatcattgggggaaaaacggaaaacgtctgttttcccctttgtgcttttctctgttttcttctttgtgcttttctctgttttcaggatttgctacagtgaacatagattgctttggggccccaaatggaattattttgaaaggaaaatgcagataatcaggtggccgcactggagcaccagctgggtaggggtagagattgcaggcaaggaggaggagctgggtggggtgccaggcaggaagagcccgtaggccccgccgatcttgtgggagtcgtgggtggcagtgttccctccagactgtaaaagggagcacctggcgggaagagggaattcttttaaacatcattccagtgcccgagcctcctggacctgttgtcatcttgaggtgggcctcccctgggtgactctagtgtgcagcctggctgagactcagtggccctgggttcttactgctgacacctaccctcaacctcaaccactgcggcctcctgtgcaccctgatccagtggctcattttccactttcagtcccagctctatccctatttgcagtttccaagtgcctggtcctcagtcagctcagacccagccaggccagcccctggttcccacatcccctttgccaagctcatccccgccctgtttggcctgcgggagtgggagtgtgtccagacacagagacaaaggaccagcttttaaaacattttgttggggccaggtgtggtggctcacacctaatcccaacacctggggaggccaaggcagaaggatcacttgagtccaggagttcaagaccagcctgggcaacatagggagaccctgtctctacaattttttttttaattagctgggcctgttggcactctcctgtagttccagctactctagaggctgaggtgggaggactgcttgagcctgggaggtcagggctgcaatgagccatgttcacaccactgaacgccagcctgggcgagaccctgtatcaaaaaagtaaagtaaaatgaatcctgtacgttatattaaggtgccccaaattgtacttagaaggatttcatagttttaaatacttttgttatttaaaaaattaaatgactgcagcatataaattaggttcttaatggaggggaaaaagagtacaagaaaagaaataagaatctagaaacaaagataagagcagaaataaaccagaaaacacaaccttgcactcctaacttaaaaaaaaaaatgaagaaaacacaaccagtaaaacaacatataacagcattaagagctggctcctggctgggcgcggtggcgcatgcctgtaatcccaacactttgggaggccgatgctggaggatcacttgagaccaggagttcaaggttgcagtgagctatgatcataccactacaccctagcctgggcaacacagtgagactgagactctattaaaaaaaaaatgctggttccttccttatttcattcctttattcattcattcagacaacatttatggggcacttctgagcaccaggctctgtgctaagagcttttgcccccagggtccaggccaggggacaggggcaggtgagcagagaaacagggccagtcacagcagcaggaggaatgtaggatggagagcttggccaggcaaggacatgcagggggagcagcctgcacaagtcagcaagccagagaagacaggcagacccttgtttgggacctgttcagtggcctttgaaaggacagcccccacccggagtgctgggtgcaggagctgaaggaggatagtggaacactgcaacgtggagctcttcagagcaaaagcaaaataaacaactggaggcagctggggcagcagagggtgtgtgttcagcactaaggggtgtgaagcttgagcgctaggagagttcacactggcagaagagaggttggggcagctgcaagcctctggacatcgcccgacaggacagagggtggtggacggtggccctgaagagaggctcagttcagctggcagtggccgtgggagtgctgaagcaggcaggctgtcggcatctgctggggacggttaagcaggggtgagggcccagcctcagcagcccttcttggggggtcgctgggaaacatagaggagaactgaagaagcagggagtcccagggtccatgcagggcgagagagaagttgctcatgtggggcccaggctgcaggatcaggagaactggggaccctgtgactgccagcggggagaagggggtgtgcaggatcatgcccagggaagggcccaggggcccaagcatgggggggcctggttggctctgagaagatggagctaaagtcactttctcggaggatgtccaggccaatagttgggatgtgaagacgtgaagcagcacagagcctggaagcccaggatggacagaaacctacctgagcagtggggctttgaaagccttggggcggggggtgcaatattcaagatggccacaagatggcaatagaatgctgtaactttcttggttctgggccgcagcctgggtggctgcttccttccctgtgtgtattgatttgtttctcttttttgagacagagtcttgctgggttgcccaggctggagtgcagtggtgcgatcatagctcactgcagccttgaagtcctgagctcaagagatccttccacctcagcctcctgagtagttgggaccacaggcttgcaccacagtgcccaactaatttcttatattttttgtagagatggggtttcactgtgtcgcccaggatggtcttgaactcctgggctcaagtgatcctcctgcctcagcctcgcaaattgctgggattacaggtgtgagccaccatgcccgaccttctctttttaagggcgtgtgtgtgtgtgtgtgtgtgtgggcgcactctcgtcttcaccttcccccagccttgctctgtctctacccagtcacctctgcccatctctccgatctgtttctctctccttttacccctctttcctccctcctcatacaccactgaccattatagagaactgagtattctaaaaatacattttatttatttattttgagacagagtctcactctgtcacccaggctggagtgcagtggtgcaatctcggctcactgcaacctccgcctcccaggttgaagcaactctcctgcctcagcctccctagtagctgggattacaagcacacaccaccatgcctagcaaatttttatatttttagtagaggaggagtgtcaccatgtttgccaagctggtctcaaactcctggcctcaggtgatctgcctaccttggtctcccaaagtgctgggattacaggtgtgagccaccacgcctgcccttaaaaatacattatatttaatagcaaagccccagttgtcactttaaaaagcatctatgtagaacatttatgtggaataaatacagtgaatttgtacgtggaatcgtttgcctctcctcaatcagggccagggatgcaggtgagcttgggctgagatgtcagaccccacagtaagtggggggcagagccaggctgggaccctcctctaggacagctctgtaactctgagaccctccaggcatcttttcctgtacctcagtgcttctgaaaaatctgtgtgaatcaaatcattttaaaggagcttgggttcatcactgtttaaaggacagtgtaaataattctgaaggtgactctaccctgttatttgatctcttctttggccagctgacttaacaggacatagacaggttttcctgtgtcagttcctaagctgatcaccttggacttgaagaggaggcttgtgtgggcatccagtgcccaccccgggttaaactcccagcagagtattgcactgggcttgctgagcctggtgaggcaaagcacagcacagcgagcaccaggcagtgctggagacaggccaagtctgggccagcctgggagccaactgtgaggcacggacggggctgtggggctgtggggctgcaggcttggggccagggagggagggctgggctctttggaacagccttgagagaactgaacccaaacaaaaccagatcaaggtctagtgagagcttagggctgctttgggtgctccaggaaattgattaaaccaagtggacacacacccccagccccacctcaccacagcctctccttcagggtcaaactctgaccacagacatttctcccctgactaggagttccctggatcaaaattgggagcttgcaacacatcgttctctcccttgatggtttttgtcagtgtctatccagagctgaagtgtaatatatatgttactgtagctgagaaattaaatttcaggattctgatttcataatgacaaccattcctcttttctctcccttctgtaaatctaagattctataaacggtgttgacttaatgtgacaattggcagtagttcaggtctgctttgtaaatacccttgtgtctattgtaaaatctcacaaaggcttgttgccttttttgtggggttagaacaagaaaaagccacatggaaaaaaaatttcttttttgtttttttgtttgcttgtttttttgagacagagtttcactctgtcgcccaggctggagtgcagtggtgcgatctccgcccactgcaagctccacctcccgggttcatgctattctcctgtctcagcctcccaagtagctgggactgcaggtgcccgccaccacacctggctaatttttttgtatttttagtagagacggggtttcaccgtgttagccaggatggtctcaatctcctgacctcgtcatctgcctgcctcggcctcccaaagtgctgagattacaggcgtgagccaccgtgcccggccagaaaaaaacatttctaagtatgtggcagatactgaattattgcttaatgtcctttgattcatttgtttaatttctttaatggattagtacagaaaacaaagttctcttccttgaaaaactggtaagttttctttgtcagataaggagagttaaataacccatgacatttccctttttgcctcggcttccaggaagctcaaagttaaatgtaatgatcactcttgtaattatcagtgttgatgcccttcccttcttctaatgttactctttacattttcctgctttattattgtgtgtgttttctaattctaagctgttcccactcctttctgaaagcaggcaaatcttctaagccttatccactgaaaagttatgaataaaaaatgatcgtcaagcctacaggtgctgaggctactccagaggctgaggccagaggaccacttgagcccaggaatttgagacctgggctgggcagcatagcaagactctatctccattaaaactatttttttttatttaaaaaataatccgcaaagaaggagtttatgtgggattccttaaaatcggagggtggcatgaattgattcaaagacttgtgcagagggcgacagtgactccttgagaagcagtgtgagaaagcctgtcccacctccttccgcagctccagcctgggctgaggcactgtcacagtgtctccttgctggcaggagagaatttcaacattcaccaaaaagtagtattgtttttattaggtttatgaggctgtagccttgaggacagcccaggacaactttgttgtcacatagatagcctgtggctacaaactctgagatctagattcttctgcggctgcttctgacctgagaaagttgcggaacctcagcgagcctcacatggcctccttgtccttaacgtggggacggtgggcaagaaaggtgatgtggcactagagatttatccatctctaaaggaggagtggattgtacattgaaacaccagagaaggaattacaaaggaagaatttgagtatctaaaaatgtaggtcaggcgctcctgtgttgattgcagggctattcacaatagccaagatttggaagcaacccaagtgtccatcaacagacaaatggataaagaaaatgtggtgcatatacacaatggaatactattcagccatgaaaaagaatgagaatctgtcatttgaaacaacatggatggaactggaggacattatgttaagtgaaataagccagacagaaggacagacttcacatgttctcacacatttgtgggagctaaaaattaaactcatggagatagagagtagaaggatggttaccagaggctgaggagggtggaggggagcagggagaaagtagggatggttaatgggtacaaaaacgtagttagcatgcatagatctagtattggatagcacagcagggtgacgacagccaacagtaatttatagtacatttaaaaacaactaaaagagtgtaactggactggctaacatggtgaaaccccgtctctactaaaaatacaaaaattagctgggcacggtggctcacgcctgtaatcccagcactttgggaggccgaggcgggccgatcacgaggtcaggagatcgagaccatcctagctaacatggtgaaaccccgtctctactacaaatacaaaaaaaagaaaaaattagccgggcatggtggtgggcgcctgtagtcccagctactcgggaggctgaggcaggagaatggcgtgaacccgggaggcggagcttgcagtgagccgagatcgcgccactgcactccagcctgggcgacaaggcaagattctatctcaaaaaaataaaaataaaataaaataaaataataaaataaaataaaataaaataaaataaaataaataaaataaaatgtataattggaatgtttataacacaagaaatgataaatgcttgaggtgatagataccccattcaccgtgatgtgattattgcacaatgtatgtctgtatctaaatatctcatgtaccccacaagtatatacacctactatgtacccatataaatttaaaattaaaaaattataaaacaaaaataaataagtaaattaaaatgtaggctggacaccgtggttcacgcctgtaatcccagtgctttgtgaggctgaggtgagagaatcacttgagcccaggagtttgagaccggcctgggtgacatagcgagaccccatcatcacaaagaatttttaaaaattagctgggcgtggtagcacataccggtagttccagctacttgggagaccgaggcaggaggattgcttgagcccaggagtttaaggctgcagtgagctacgatggcgccactgcattccagcctgggtgacagagtgagagcttgtctctattttaaaaataataaaaagaataaataaaaataaattaaaatgtaaatatgtgcatgttagaaaaaatacacccatcagcaaaaagggggtaaaggagcgatttcagtcataattggagagatgcagaataagccagcaatgcagtttcttttattttggtcaaaaaaaataagcaaaacaatgttgtaaacacccagtgctggcagcaatgtggtgaggctggctctctcaccagggctcacagggaaaactcatgcaacccttttagaaagccatgtggagagttgtaccgagaggttttagaatatttataactttgacccagaaattctattctaggactctgtgttatgaaaataacccatcatatggaaaaagctcctttcagaaagaggttcatgggaggctgtttgtattttttttttctttgcatcaaatccagctcctgcaggactgtttgtattattgaagtacaaagtggaatcaatacaaatgttggatagcaggggaacaatattcacaaaatggaatgggacatagtattaaacatagtgcttctgatgaccgtagaccatagacaatgcttaggatatgatatcacttcttttgttgttttttgtattttgagacgaagtctcattctgtcacccaggctggagttcagtggcgccatctcagctcactgcaacctccatctcccgggttcaagctattctccttcctcaacctcccgagtagctgggttgcgcaccaccatgcctggctaacttttgtatttttagtacagacggggtttcaccacgttggccaggctgctcttgaactcctgacgtcaggtgatccaccagccttgacctcccaaagtgctaggattacaggagccactgtacccagcctaggatatgatatcacttcttagagcaagatacaaaattgcatgtgcacaataattctaccaagtataggtatacaggggtagttatatataaatgagacttcaaggaaatacaacaaaatgcaatcgtgattgtgttagggtggtaagaaaacggtttttgctttgatgagctctgttttttaaaatcgttatattttctaataaaaatacatagtcttttgaaggaacataaaagattatgaagaaatgagttagatattgattcctattgaagattcagacaagtaaaattaaggggaaaaaaaacgggatgaaccagaagtcaggctggagttccaaccccagatccgacagcccaggctgatggggcctccagggcagtggtttccacccagcattctcaaaagagccactgaggtctcagtgccattttcaagatttcggaagcggcctgggcacggctggtccttcactgggatcaccacttggcaattatttacacctgagacgaatgaaaaccagagtgctgagattacaggcatggtggcttacgcttgtaatcggctttgggaagccgaggtgggctgattgcttgagcccaggagtttcaaactatcctggacaacatagcatgacctcgtctctacaaaaaatacaaaaaatttgccaggtgtggtggcatgtgcctgtggtcccagctacttgggaggctgaagtaggagaatcccctgagccctgggaagtcgaggctgcactgagccgtgatggtgtcactgcactccagcctgggtgacaaagtgagaccctatctcacaaagaaaaaaaacaaaacaaaaaacccaaagcacactgtttccactgtttccagagttcctgagaggaaaggtcaccgggtgaggaagacgttctcactgatctggcagagaaaatgtccagtttttccaactccctaaaccatggttttctatttcatagttcttaggcaaattggtaaaaatcatttctcatcaaaacgctgatattttcacacctccctggtgtctgcagaaagaaccttccagaaatgcagtcgtgggagacccatccaggccacccctgcttatggaagagctgagaaaaagccccacgggagcatttgctcagcttccgttacgcacctagtggcattgtgggtgggagagggctggtgggtggatggaaggagaaggcacagcccccccttgcagggacagagccctcgtacagaagggacaccccacatttgtcttccccacaaagcggcctgtgtcctgcctacggggtcagggcttctcaaacctggctgtgtgtcagaatcaccaggggaacttttcaaaactagagagactgaagccagactcctagattctaattctaggtcagggctaggggctgagattgtaaaaatccacaggtgattctgatgcccggcaggcttgagaacagccgcagggagttctctgggaatgtgccggtgggtctagccaggtgtgagtggagatgccggggaacttcctattactcactcgtcagtgtggccgaacacatttttcacttgacctcaggctggtgaacgctcccctctggggttcaggcctcacgatgccatccttttgtgaagtgaggacctgcaatcccagcttcgtaaagcccgctggaaatcactcacacttctgggatgccttcagagcagccctctatcccttcagctcccctgggatgtgactcgacctcccgtcactccccagactgcctctgccaagtccgaaagtggaggcatccttgcgagcaagtaggcgggtccagggtggcgcatgtcactcatcgaaagtggaggcgtccttgcgagcaagcaggcgggtccagggtggcgtgtcactcatccttttttctggctaccaaaggtgcagataattaataagaagctggatcttagcaacgtccagtccaagtgtggctcaaaggataatatcaaacacgtcccgggaggcggcagtgtgagtaccttcacacgtcccatgcgccgtgctgtggcttgaattattaggaagtggtgtgagtgcgtacacttgcgagacactgcatagaataaatccttcttgggctctcaggatctggctgcgacctctgggtgaatgtagcccggctccccacattcccccacacggtccactgttcccagaagccccttcctcatattctaggagggggtgtcccagcatttctgggtcccccagcctgcgcaggctgtgtggacagaatagggcagatgacggaccctctctccggaccctgcctgggaagctgagaatacccatcaaagtctccttccactcatgcccagccctgtccccaggagccccatagcccattggaagttgggctgaaggtggtggcacctgagactgggctgccgcctcctcccccgacacctgggcaggttgacgttgagtggctccactgtggacaggtgacccgtttgttctgatgagcggacaccaaggtcttactgtcctgctcagctgctgctcctacacgttcaaggcaggagccgattcctaagcctccagcttatgcttagcctgcgccaccctctggcagagactccagatgcaaagagccaaaccaaagtgcgacaggtccctctgcccagcgttgaggtgtggcagagaaatgctgcttttggcccttttagatttggctgcctcttgccaggagtggtggctcgtgcctgtaattccagcactttgggagactaaggcgggaggttcgcttgagcccaggagttcaagaccagcctgggcaacaatgagacccctgtgtctacaaaaagaattaaaattagccaggtgtggtggcacgcacctgtagtcccagctacttgggaggctgaggtgggaggattgcctgagtccgggaggcggaagttgcaaggagccatgatcgcgccactgcacttcaacctaggcaacagagtgagactttgtctcaaaaaacaatcatataataattttaaaataaatagatttggcttcctctaaatgtccccggggactccgtgcatcttctgtggagtgtctccgtgagattcgggactcagatcctcaagtgcaactgacccacccgataagctgaggcttcatcatcccctggccggtctatgtcgactgggcacccgaggctcctctcccaccagctctcttggtcagctgaaagcaaactgttaacaccctggggagctggacgtatgagacccttggggtgggaggcgttgatttttgagagcaatcacctggccctggctggcagtaccgggacactgctgtggctccggggtgggctgtctccagaaaatgcctggcctgaggcagccacccgcatccagcccagagggtttattcttgcaatgtgctgctgcttcctgccctgagcacctggatcccggcttctgccctgaggccccttgagtcccacaggtagcaagcgcttgccctgcggctgctgcatggggctaactaacgcttcctcaccagtgtctgctaagtgtctcctctgtctcccacgccctgctctcctgtccccccagtttgtctgctgtgaggggacagaagaggtgtgtgccgcccccacccctgcccgggcccttgttcctgggattgctgttttcagctgtttgagctttgatcctggttctctggcttcctcaaagtgagctcggccagaggaggaaggccatgtgctttctggttgaagtcaagtctggtgccctggtggaggctgtgctgctgaggcggagctggggagagagtgcacacgggctgcgtggccaacccctctgggtagctgatgcccaaagacgctgcagtgcccaggacatctgggacctccctggggcccgcccgtgtgtcccgcgctgtgttcatctgcgggctagcctgtgacccgcgctgtgctcgtctgcgggctagcctgtgtcccgcgctctgcttgtctgcggtctagcctgtgacctggcagagagccaccagatgtcccgggctgagcactgccctctgagcaccttcacaggaagcccttctcctggtgagaagagatgccagcccctggcatctgggggcactggatccctggcctgagccctagcctctccccagcctgggggccccttcccagcaggctggccctgctccttctctacctgggacccttctgcctcctggctggaccctggaagctctgcagggcctgctgtccccctccctgccctccaggtatcctgaccaccggccctggctcccactgccatccactcctctcctttctggccgttccctggtccctgtcccagcccccctccccctctcacgagttacctcacccaggccagagggaagagggaaggaggccctggtcataccagcacgtcctcccacctccctcggccctggtccaccccctcagtgctggcctcagagcacagctctctccaagccaggccgcgcgccatccatcctccctgtcccccaacgtccttgccacagatcatgtccgccctgacacacatgggtctcagccatctctgccccagttaactccccatccataaagagcacatgccagccgacaccaaaataattcgggatggttccagtttagacctaagtggaaggagaaaccaccacctgccctgcaccttgttttttggtgaccttgataaaccatcttcagccatgaagccagctgtctcccaggaagctccagggcggtgcttcctcgggagctgactgataggtgggaggtggctgcccccttgcaccctcaggtgaccccacacaaggccactgctggaggccctggggactccaggaatgtcaatcagtgacctgccccccaggccccacacagccatggctgcatagaggcctgcctccaagggacctgtctgtctgccactgtggagtccctacagcgtgccccccacaggggagctggttctttgactgagatcagctggcagctcagggtcatcattcccagagggagcggtgccctggaggccacaggcctcctcatgtgtgtctgcgtccgctcgagcttactgagacactaaatctgttggtttctgctgtgccacctacccaccctgttggtgttgctttgttcctattgctaaagacaggaatgtccaggacactgagtgtgcaggtgcctgctggttctcacgtccgagctgctgaactccgctgggtcctgcttactgatggtctttgctctagtgctttccagggtccgtggaagcttttcctggaataaagcccacgcatcgaccctcacagcgcctcccctctttgaggcccagcagataccccactcctgcctttccagcaagatttttcagatgctgtgcatactcatcatattgatcacttttttcttcatgcctgattgtgatctgtcaatttcatgtcaggaaagggagtgacatttttacacttaagcgtttgctgagcaaatgtctgggtcttgcacaatgacaatgggtccctgtttttcccagaggctcttttgttctgcagggattgaagacactccagtcccacagtccccagctcccctggggcagggttggcagaatttcgacaacacatttttccaccctgactaggatgtgctcctcatggcagctgggaaccactgtccaataagggcctgggcttacacagctgcttctcattgagttacacccttaataaaataatcccattttatcctttttgtctctctgtcttcctctctctctgcctttcctcttctctctcctcctctctcatctccaggtgcaaatagtctacaaaccagttgacctgagcaaggtgacctccaagtgtggctcattaggcaacatccatcataaaccaggtagccctgtggaaggtgagggttgggacgggagggtgcagggggtggaggagtcctggtgaggctggaactgctccagacttcagaaggggctggaaaggatattttaggtagacctacatcaaggaaagtgttgagtgtgaaacttgcgggagcccaggaggcgtggtggctccagctcgctcctgcccaggccatgctgcccaagacaaggtgaggcgggagtgaagtgaaataaggcaggcacagaaagaaagcacatattctcggccgggcgctgtggctcacgcctgtaattccagcactttgggaggccaaggtgggtggatcatgaggtcaggagattgagaccatcctggctaacacagtgaaaccccgtctctactaaaaatacaaaaaattagccgggcgtggtggtgggcgcctgtagtcccagctactccggaggctgaggcaggaaaatggcgtgaacccggaaggcggagcttgcagtgagcggagtgagcagagatcgcgccactgcactccagcctgggcgacagagcgagactccgtctcaaaaaaaaaaagcacatgttctcgcttctttgtgggatccaggagatagagaatagaaggatggttaccagaggctgggaagggtagtgaggggatggtggggggatggtcaatgggtacaaaaaaaatagaataagacctagtatttgatagtgcaacagggtgactatagtcaataataatttaattgtacatttaaaaataactaaaagatagccgggtgcagtggcttacgtctgtaatcccagtactttgggaggctgaggtgggcgtttgagaccagcctggccaacatggtgaaaccccatctctactaaaaatacaaaaattagccaggcatggtggcgggcgcctgtaatcccagctactcgggaggctgaggcaggagaatcacttgaacctgggaggcagaggttgcagtgagccgagatcttgccactgcactccagcctgggtgacagtgaaactccgtctcaaaaataaaaataaaaatacagctgggcacggtggctcacgcctgtaatcccagcactttgggaggccgaggcgagcggatcacaaggtcaggagatatagaccatcctggctaacacggtgaaacccggtctctactaaaaatacaaaaaattagccaggcgtggtggcaggtgcctatagtcccagctactcacaaggctgaggcaggagaatggcatgaacctgggaggcggagcttgcagtgagccgagattgtgccactgcactccagcctgggcgagagagtgagactccgtctcaaaacaaaaacaaaaacaaaaacaaaaacaaacacacaacaaaaacctaaaagaatataaatggattgtttgtaacacaaaggacaaatgtttgaggggatggataccccattttccatgatgtgattattatacattgtgtgtctgtatcaaaacatctcatgagccccataaatatatacacctaactatgtacccacaaaaattaaaaaaatatattttttaaggtgaagagggaggcgagatgctggccttaacccctaacccgttgttctccctgcaagctgtccacagggcctctcagactcgaggttcagctatatggatgcatgagcttggtccccagccaacatgggagacacttcaccatcggcagcagctacagcacaggaaccctgggtcactgccatgtcccctctgtgactttgtttaaacagaaaatgatgctctgggccggctgtggtggcccacacctataatcccagcaccttgggaggcgggggtgggcagattgcctgaggtcaggagttggagatcagcctggccgacatggcgaaaccccatgtctactaaaaatacaaaaactagccaggcatggtggcacatgcctgtaatcccagctacttgggaggctgaagcaggagaatcacttgaacccaggaggcagaggctgagtgagccaagatcgtgccaatgcactccagcttgggtgagggagtgagactccgtctcaaaaaaaaaaaaaaagaaagaaaaagaaaagaaagtgatcctactggaaccatgcttactcccctccccacctcacactgtgtagaaattagtgctgtcggccaggcgcggtggctcatgcctgtaatcgcagcactttgggaggccaaggcaggcggatcacgaggtcaggagatcaagaccatcctggctaacacagtgaaaccctgtctctactaaaaatacaaaaaattagccgggcatggtggcaggcacctgtagtcccaactacttgggaggctgaggcaggagaatggcatgaacctgggaggcggagcttgcagtgagccaagatcgcgccactgcataccagcctaggtgacagagtgagactcagcaaaaaaagaaagaaagaaagaaagaaatcagtgctgtctatacttctttctgcagtgatggaaatattctgtatctgtgctgtccagtatagtagccactagctacatgtggcacttgaaacatggctggtacagttgaggaagagtggctgccatatcggacgacacagctatagattctgtcaccccaccccgagagtccagagcggggacttctgccttaggccctattcagggctgatttttacttgaacccttactgtgggaagagaaggccatgagaagttcagtctagaatgtgactccttattttctggctcccttggacactttgtgggatttagtctccctgtggaaagtattccacaagtggtgccactaccccagctgtgagagcagctgggagctgcttttgtcatctttccctggaaagtcctgtgggctgtctcttcctcatgccttgtcccatgcttgggcatggtgtcaagcgtcaggagggagaaagggtccttatttatttatttagagagggacccttcttctgttcccaggctggagtgcagtggtgcgatctcggctcactgcaacctccgcctcctgggttcaagtgattctcctgcctcagcctcctgagtagctgagattacaggcacatgccaacatgcccggctaattttttttttttttttttttttttttttttttttttttttgagatggagttgtactctcattgcccaggctggaatgtaatggcacaatctcggctcactgcaacctccacctcctggattcaagcaattctcctgtctcagcttcccaagtagctgggattacaggtgcccgccaccatgctcaactaatttttgtattttttttttagtagagacgaggtttcaccatgttggtcagactggtctcaaactcctgacctcaggtgatccacctgcctcggcctcccaaagtgctaggattacaggcatgagccaccacgcccggcctgaaagggttcttatttagtgtgcattttgacattcaatttaattccaaggtcttgtggggtcatggtttacaggatgttgatatagaaaagacttcacttaatgggccgggcgcagtggctcatgcctgtaatcccagcactttgggaggccgaggcaggcagatcaggaggtcaggagattgagaccatcctggctaacacagtgaaaccccatctctactgaaaatacaaaaaattagctgggcgtggtggcaggcacctgtagtcccagccactcggttggctgaggcaggagaatggcatgaacccgggaggcggagcttgcagtgagcagagaccatgccactgcactccagcctgggcgacagagcaagactctgtctcaagaaaaaaaaaaaaaaacagactttacttactggaagccaaccaatgtatatttagagtaatttttcctgggctgagctgtcatttacttttgcagtatctcaagaagaagagtttacagtgtaaatatttgatgcacactttgattatatagatgaagcaaactattttcaagagctttgcaaggacttacttgtatccaaacaccattctaaaaggagtcttacctacttctaaaggctggtctctacttggaaccacttgcttggccctggttcaagtcctgctgcaaacctggaagtcctgtcattgtcttcttccctccagagcagtggcacccaatctaatttttgctgtgccccagcagcccctggcactttgccctgtagactgcagacctcatgtaatgtatgttaagtccacagaaccacagaagatgatggcaagatgctcttgtgtgtgttgtgttctaggaggtggccaggtggaagtaaaatctgagaagcttgacttcaaggacagagtccagtcgaagattgggtccctggacaatatcacccacgtccctggcggaggaaataaaaaggtaaagggggtagggtgggttggatgctgcccttgggtatatgggcattaatcaagttgagtggacaaaggctggtccagttcccagaggaggaaaacagaggcttctgtgttgactggctggatgtgggccctcagcagcatccagtgggtctccactgcctgtctcaatcacctggagctttagcacgtttcacacctgggccccaacctggagaggctgaccaatgggtctcaggggcagctcggttgctggagtttttgtttttatttatttttatgtatttaaggcagggtctctgtattagtccattctcacactgctaataaagacatacccaagactgggtaatttataaaggaaagaggtttaatggactcacagttccacatggctggggaggcctcaaaatcatggcggaaggcaaaggagaagcaaaggcatttcttacatggcgacaggcaagagagcgtgtgcaggggaactcccatttataaaaccatcagacctcatgagatttattcactatcatgagaacagcatgggaaagacccgcccccatgattcagttacctcccactgggtccctcccatgacacatggaattatgggagctacaattcaagatgagatttgggtggggacacagccaaaccatatcagtctccctctgtcatccaggctggagtgcactggcatgatctcggctcactgcagcctctacctccctgggtcaggtgatcttcccacctcagcctcccaggtagctggaactacaggtacctgccactatgcctggctaaatattttgtatttcctgtggagacgaggttttgccacgttgcccaggctggtcttgaactcctgaggtcaagcaatatgcccacctcggcctcccaaggtgctgggattacaggtgtgagccacagtgctcggcctaagtcactgcagtttttaaagctcccaggtgattcttcagtgcagtcaaaagtgagaactggctgggtgcggtggctcatgcctgtaatcccagcaccttgggaggcgaaggtgggcagatggcttgaggtcaggagttcaagaccagcctggccaacatggtaaaaccccatctctactaaaaatacaaaagttagctgggtgtggtggtgcgtgcctgtaatcccagctacttgggaggctgaggcatgagaattgcttgaacccaggggacagaggttgtagtgagccgagatcgtgccactgcactccagcctgggcaacagagtgagattccatctcacaaaaaaaaaaaaaagcgagaaccactgtcctaggccctgatgtttgcaggcaactaaaaaaggaagtggacatccccagtcagctgtggcgcaccaagaacaagtcatgggaacataacctaattttctaaatgggttactaggcacttagagcaaaacaatgatgccgaaatcctgatttcagcaaagcctctgcctgcctgtcttggaagtatccacatgaggctgctggggccttggtgtccccagcagtttctagtctctaggtcttgctgtgggtgtctgtgcagtgagggtgtgtgtggcgctgggtgagctctgtctaggcctggcacaggatgcggtctggtagctgctgcttctcttctgcagaagcgcagccaagcaccctctggggtttcaggcccacacccagcctgaagttctgggagtggctcactttccaaccttcagggtctcccagcagctgactggggagtggtggagggaaaagggattgtattagtccgttttcacgccgctgatgaagacatacccgatactgggcagtctaaaagatagaggtctgatggactcacagttccacgtgactggggaggcctgacaatcatggtggaaggtgaaaggcttgtctcacacggtggcagacaagagaaaagagcttgtgcaggggaactcccctttataaaaccatcagatctcgggagacttattcactatcatgagaacagcacgggaaagaccctcctctatgattcaattacctcccaccaggtccctcccacaacatgtaggaattgtgggaactacaattcaagatgacatttgggtggggacacagccaaaccatatcagggcgtcccagaaagggtatagggtctgagacccaagtcagcatgagaaagtatgcttctcatggtggcccagttgggtggaagtggcagccgggccgtctttccaccaggccactcaagtagcagctgagagacccctgccctggccagtccccgccctcccctcttgccactgcctctggttctgaacagatgggcaccctcatcttgtatttgtgattaatgtctaacaatgtagttttgtgagaagggtttgctgatacagccttgctgcagatgctgcgaactgtggcctggggcagaccttacctccagacacgccctgaggcaggggagggcactggcccgtagctggccgagagctctcgggttgcgcgacagggatacttttcagcggctgggtcgctatccaaagtgagaaaacgaggagggaccaggaggctgtccgcctcaagagatgtgggggccaggtccagttatctggggaagcagtaagcttctctgctgtttctaaccccaggcctcccctggtctaaggcagggcctcccagcctcggggcactttaaagatatctgggcctggccccatccccacagtctgactgagtgggtctggatagggcctgagcattggtgatttcctgggtgaaaggaggcccctcacagtctctggaagcttctctgtgttaggaaaagctctgggcttgactctgctttgaaagtcaagatccgcaaatcctctcagcctcagtttctccttcagcaagatgaaatggaaatgctgtacctacgtcccggggtggttgtgagacccaaaaaagacaatgttctggaaggttcctggtgcgttgcagtcctctaagaacctgagttagagccacgctgagtctcagcttcttggctccttctgtttcaaactcgtccatgtgatagctcaggaagggtaggcagggccctgccccctactcagaaaacaccatcctggtcctggggatccccgcagcattagtcccctgttttcccagtgtattgagaaaaattgctaacaagcagtggggcacaccaccagcctcctgggttcctttcagtttggggatttttggacattcccaggaatgtcttaaaaaacacttcaaaaaacattaacataaatatttttatcaaagcctgtattaaatggtctttcaagaaaatacagtaacaggtcaggcatggtggctcatgcctgtaaccccagcactttgggaggccaaggcaggcagatcacctgaaatcaggagttcaagaccaacctggccaacacagccaaatcccatctctacaaaaaatacaaaaattagctgggtgtggtggcacacacctgtagtcccagctacttgggaggccgaggcaggagaattgcttgatcccggaggcggaggttgcagtgagccgagatcgtgccactgcactccagcgtgggtgacaaggtgaatctttgtctcaaaaaaaaaaaaaaaaaaaagataaaatacagtatacagtaatagagaacaatccttttttcaaagtagtgaccccaaatgaacaaaatatgcatctagcttaaatgcgaacctggttttctctacgcccattcaagcccctgcaataggggcccttcaccccgcatccatggactcctaaaattatatggaaaatggctgtgtgtgagtgtggatggacatgtgcacacatatttttggctttaccagatgctcaaagagcctaggacccaaaaagggctgagaatgaccgtgtcggccacttcagggtcatcaggaattgctgtgcactgctcacttctccagtgaacactttctgcttctgtgtttcctggtatcctttgggactcctggctaggtcatgtgtttctctactttcaaaagggcttcagccaggcacgatggcatgagcctgtagtcccagttgctctggaggttaaggtgggaagattgcttgagcccaggaatttgaggccagcctgggcaagtagataggtagatgattgatagatagatagatagataaatagatggatagataagtcgctagacagtcatccatccacccatccacacataaaaaggcctttgtcatgtcatgttttgtggcccacctgccagtgttgcccacagttgctgcccctccaaactcatcagtcactggcaaacaggaggaatgtgtggctcatgtctgggcatcagtggctgtgggagacatccttgatcttctccagcttctccttccacattttcctttgcaatctggcaatatctattaaaataaaatgtgcatgccttttgacctaagagcttcacttctaggacccacttacacgtgtgtgacatgatgttcatacgggtttatttatctgaggttgttcatacacaccattgcctgtaatcactaaaggcgggagcagcctacacatccatccacagaggagtagatgccttttggtacatccgtggcgacggaatactaagcagcctgtgtatctatacactcacacgtgtttgtttatgtgtggaatatctctggagggtacacaagaaacttaaaatgatcactgtctctggggagggtacctgggtgcctgggaggcaggtcagggaaggagtgggcacaggtattaccaattggaagacaataaaaacaacagctcctggccaggcgcagtggctcacgcctgtaatggcagcactctgagaggctgaggcgggcagattgcttgcgtccaggagttcaagaccagcctgggcaacatagcaaaaccccgtttctattaaaaatacaaaaaattagccaggtgtggtggcatgcacctgtaatcccagctactcgggaggctgaggtgggagaatcacctgagcctgggaggtcaaggctgcagtgaggtgagattgtgccaccgcactctagcctgggcgatagagcaagaccctgtctcaaaaacaaacaaaaaacagtccctggcactctgggccaggcctggcagggcagttggcagggctggtctttctctggcacttcatctcaccctccctcccttcctcttcttgcagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaataaggtctccattcatggattccaaggacaagaaagtcatatagaatgtctattttttaagttctttcccacgcacccttagataatttagctcagaacaggaaatgatagtattaataaaagctggacatcaggattaacagctctctctggggccctgaaggtgagagttctcagacttgctcatttgcagttgcttctttgtgatgctggcaaaccatcctagtcccattcaaagggcaatacaaagccttgtggctgacctcacgatgcagcactcagtttgcaagaccggcaccagtgtatgcaaacctgagaaggttggggatgaggatatgggatctttcatccctggaaatttagtccagaggcctggggctggagcagaacaccaagccaatcagcttaatgaatggcttagattcctgctaggtttgcagagctgccttctttcctttggtaccttattatagattgaggagtatttctgctaaaccaagatagggataaccagatagcatcttcatagcaatgccacaaaggaaaacaaaaacaaaacagtaatccatcatattattccttagtaactatgccaaggtcatgatactgaatccttagattgtttcaaaatactacttttctttgctcttcctgatgtgtttgccaccgcaggcagatgtttaagtaaaacagattttaactgcagctacaaaagcagcaacaggccagcaaaagagaagtgctatctcagagagcatggctttcagagccacaagagacagcctcactggctgtttcagcttgactgccatgcaaagaagagagcagagggagaaccagccccacccacttattcatcttgtacaaaaaaaaagcacctaccagcctaggctacatagtgagacactatctccacaaaaaacccacgaaaactagctgggtatggtggcacatgcctacagtcccagctactggtaaggctgtggtgggaggatctcttgaggccaggaaggagatccaggctgcagtgagccaagattgcaccactgcactccagtctggacaatcgagcaagatcccatctcaaacaataaaaaaaaaaagcgtgtaacctcctcagaagaaagatgttataatctcaggcagcaggcaagaaccaatccaggctctaagc

SEQ ID NO: 5 - DNA, 594 bp, Homo sapiens
  CDS (375)..(377)
cacgaagggaccgcgaagggcagcgccgagaggaaacgagccgggagacgccggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggtttgggggacaggaaagatcaagggggctacaccatgcaccaagaccaagagggtgacacggacgctggcctgaaagctgaagaagcaggcattggagacacccccagcctggaagacgaagctgctggtcacgtgacccaagctcgcatggtcagtaaaagc

SEQ ID NO: 6 - DNA, 5631 bp, Homo sapiens
  CDS (323)..(1468)
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 7 - DNA, 6762 bp, Homo sapiens
  CDS (323)..(2599)
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 8-9 - skipped (2 entries)

SEQ ID NO: 10 - DNA, 21 bp, Artificial sequence
  Primer
aagattgggtccctggacaat

SEQ ID NO: 11 - DNA, 26 bp, Artificial sequence
  Primer
agcttgtgggtttcaatctttttatt

SEQ ID NO: 12 - DNA, 19 bp, Artificial sequence
  Probe
cacccacgtccctggcgga

SEQ ID NO: 13-19 - skipped (7 entries)

SEQ ID NO: 20 - DNA, 20 bp, Artificial sequence
  Synthetic oligonucleotide
ttgtagactatttgcacact

SEQ ID NO: 21 - DNA, 20 bp, Artificial sequence
  Synthetic oligonucleotide
cacaggcagatgcgaaccct

SEQ ID NO: 22 - DNA, 20 bp, Artificial sequence
  Synthetic oligonucleotide
tggtggagacaagacattct

SEQ ID NO: 23 - DNA, 20 bp, Artificial sequence
  Synthetic oligonucleotide
ccatcccctaatagttagca

SEQ ID NO: 24 - DNA, 20 bp, Artificial sequence
  Synthetic oligonucleotide
catgaggcttgggatctgaa

SEQ ID NO: 25 - DNA, 20 bp, Artificial sequence
  Synthetic oligonucleotide
gtgatcttccatcacttcga

SEQ ID NO: 26 - DNA, 20 bp, Artificial sequence
  Synthetic oligonucleotide
gtccactaacctttcaggcc

SEQ ID NO: 27 - DNA, 20 bp, Artificial sequence
  Synthetic oligonucleotide
agcatcagaggtttcagagc

SEQ ID NO: 28 - DNA, 20 bp, Artificial sequence
  Synthetic oligonucleotide
gttggagtgctcttagcatc

SEQ ID NO: 29 - DNA, 20 bp, Artificial sequence
  Synthetic oligonucleotide
ggcagcctgcttgccgggag

SEQ ID NO: 30 - DNA, 20 bp, Artificial sequence
  Synthetic oligonucleotide
gaggatttccttggagagag

SEQ ID NO: 31 - DNA, 20 bp, Artificial sequence
  Synthetic oligonucleotide
gttcactgaccttgggtcac

SEQ ID NO: 32 - DNA, 20 bp, Artificial sequence
  Synthetic oligonucleotide
atgatttctagaggtcatgc

SEQ ID NO: 33 - DNA, 20 bp, Artificial sequence
  Synthetic oligonucleotide
agaggaaatccacagggagg

SEQ ID NO: 34 - DNA, 20 bp, Artificial sequence
  Synthetic oligonucleotide
ttcagagggctctggaaggt

SEQ ID NO: 35 - DNA, 20 bp, Artificial sequence
  Synthetic oligonucleotide
acaccatgagggcacccgtc

SEQ ID NO: 36 - DNA, 20 bp, Artificial sequence
  Synthetic oligonucleotide
accatgcgagctgataaaat

SEQ ID NO: 37 - DNA, 20 bp, Artificial sequence
  Synthetic oligonucleotide
aaggttttagcagaggaacg

SEQ ID NO: 38 - DNA, 20 bp, Artificial sequence
  Synthetic oligonucleotide
aggaaggtggctctgggcac

SEQ ID NO: 39 - DNA, 20 bp, Artificial sequence
  Synthetic oligonucleotide
ccagagctgggtggtgtctt

SEQ ID NO: 40 - DNA, 20 bp, Artificial sequence
  Synthetic oligonucleotide
ggtggagtacggaccactgc

SEQ ID NO: 41 - DNA, 20 bp, Artificial sequence
  Synthetic oligonucleotide
aagacggcgacttgggtgga

SEQ ID NO: 42 - DNA, 20 bp, Artificial sequence
  Synthetic oligonucleotide
tggtgcttcaggttctcagt

SEQ ID NO: 43 - DNA, 20 bp, Artificial sequence
  Synthetic oligonucleotide
ttatctgcacctttggtagc

SEQ ID NO: 44 - DNA, 20 bp, Artificial sequence
  Synthetic oligonucleotide
tcttattaattatctgcacc

SEQ ID NO: 45 - DNA, 20 bp, Artificial sequence
  Synthetic oligonucleotide
agatccagcttcttattaat

SEQ ID NO: 46 - DNA, 20 bp, Artificial sequence
  Synthetic oligonucleotide
cgttgctaagatccagcttc

SEQ ID NO: 47 - DNA, 20 bp, Artificial sequence
  Synthetic oligonucleotide
gagccacacttggactggac

SEQ ID NO: 48 - DNA, 20 bp, Artificial sequence
  Synthetic oligonucleotide
ggtggcgcaggctaagcata

SEQ ID NO: 49 - DNA, 20 bp, Artificial sequence
  Synthetic oligonucleotide
gagccacacttggaggtcac

SEQ ID NO: 50 - DNA, 20 bp, Artificial sequence
  Synthetic oligonucleotide
acagggctacctggtttatg

SEQ ID NO: 51 - DNA, 20 bp, Artificial sequence
  Synthetic oligonucleotide
attttacttccacctggcca

SEQ ID NO: 52 - DNA, 20 bp, Artificial sequence
  Synthetic oligonucleotide
ggacccaatcttcgactgga

SEQ ID NO: 53 - DNA, 20 bp, Artificial sequence
  Synthetic oligonucleotide
gtgggtttcaatctgcaaga

SEQ ID NO: 54 - DNA, 20 bp, Artificial sequence
  Synthetic oligonucleotide
gtcagcttgtgggtttcaat

SEQ ID NO: 55 - DNA, 20 bp, Artificial sequence
  Synthetic oligonucleotide
gatcacaaaccctgcttggc

SEQ ID NO: 56 - DNA, 20 bp, Artificial sequence
  Synthetic oligonucleotide
tgattttgaagtcccgagcc

SEQ ID NO: 57 - DNA, 20 bp, Artificial sequence
  Synthetic oligonucleotide
atcactgattttgaagtccc

SEQ ID NO: 58 - DNA, 20 bp, Artificial sequence
  Synthetic oligonucleotide
cagaagcagctttcagagcc

SEQ ID NO: 59 - DNA, 20 bp, Artificial sequence
  Synthetic oligonucleotide
aaatcctttgttgctgccac

SEQ ID NO: 60 - DNA, 20 bp, Artificial sequence
  Synthetic oligonucleotide
cccacaggctgccctgcaga

SEQ ID NO: 61 - DNA, 20 bp, Artificial sequence
  Synthetic oligonucleotide
ggaggtcatccacgaagtgc

SEQ ID NO: 62 - DNA, 20 bp, Artificial sequence
  Synthetic oligonucleotide
ggaagcccctcaactcaggc

SEQ ID NO: 63 - DNA, 20 bp, Artificial sequence
  Synthetic oligonucleotide
ggtctgcaaagtggccaaaa

SEQ ID NO: 64 - DNA, 20 bp, Artificial sequence
  Synthetic oligonucleotide
tggttagccctaaagtccca

SEQ ID NO: 65 - DNA, 20 bp, Artificial sequence
  Synthetic oligonucleotide
acaaagagaactggttagcc

SEQ ID NO: 66 - DNA, 20 bp, Artificial sequence
  Synthetic oligonucleotide
aagaggcacaagtccttaca

SEQ ID NO: 67 - DNA, 20 bp, Artificial sequence
  Synthetic oligonucleotide
cagagatgccagtggcccag

SEQ ID NO: 68 - DNA, 20 bp, Artificial sequence
  Synthetic oligonucleotide
ggaaccgaatcagatcatga

SEQ ID NO: 69 - DNA, 20 bp, Artificial sequence
  Synthetic oligonucleotide
tggagggctgatactatgca

SEQ ID NO: 70 - DNA, 20 bp, Artificial sequence
  Synthetic oligonucleotide
aaaagaaccatttccaaggg

SEQ ID NO: 71 - DNA, 20 bp, Artificial sequence
  Synthetic oligonucleotide
atccaactacaactcaacag

SEQ ID NO: 72 - DNA, 20 bp, Artificial sequence
  Synthetic oligonucleotide
atcatagtcactctggtgaa

SEQ ID NO: 73 - DNA, 20 bp, Artificial sequence
  Synthetic oligonucleotide
gccacacgagtcccagtgtg

SEQ ID NO: 74 - DNA, 20 bp, Artificial sequence
  Synthetic oligonucleotide
aaaacttgggaggccccagc

SEQ ID NO: 75 - DNA, 20 bp, Artificial sequence
  Synthetic oligonucleotide
gatccaggacaggcaattca

SEQ ID NO: 76 - DNA, 20 bp, Artificial sequence
  Synthetic oligonucleotide
tcctcaggcaggcagcttgg

SEQ ID NO: 77 - DNA, 20 bp, Artificial sequence
  Synthetic oligonucleotide
ttctcatggcagcagatgga

SEQ ID NO: 78 - DNA, 20 bp, Artificial sequence
  Synthetic oligonucleotide
ttaggcagcaatgttttgca

SEQ ID NO: 79 - DNA, 20 bp, Artificial sequence
  Synthetic oligonucleotide
agagttctgggcccagagac

SEQ ID NO: 80 - DNA, 20 bp, Artificial sequence
  Synthetic oligonucleotide
aggaagaggaaccgaggtgc

SEQ ID NO: 81 - DNA, 20 bp, Artificial sequence
  Synthetic oligonucleotide
tcttaggctggccccaagag

SEQ ID NO: 82 - DNA, 20 bp, Artificial sequence
  Synthetic oligonucleotide
tcaatttatctgccagcact

SEQ ID NO: 83 - DNA, 20 bp, Artificial sequence
  Synthetic oligonucleotide
tcctcatttaagatcacaag

SEQ ID NO: 84 - DNA, 20 bp, Artificial sequence
  Synthetic oligonucleotide
atggaactattgataaagtg

SEQ ID NO: 85 - DNA, 20 bp, Artificial sequence
  Synthetic oligonucleotide
caccactgaagtcaatttaa

SEQ ID NO: 86 - DNA, 20 bp, Artificial sequence
  Synthetic oligonucleotide
agtttaagtgctgcacccca

SEQ ID NO: 87 - DNA, 20 bp, Artificial sequence
  Synthetic oligonucleotide
gaaatcatgaaaagggttac

SEQ ID NO: 88 - DNA, 20 bp, Artificial sequence
  Synthetic oligonucleotide
ctctagcaaatgtggttgaa

SEQ ID NO: 89 - DNA, 20 bp, Artificial sequence
  Synthetic oligonucleotide
agccagctgcctgggaaagc

SEQ ID NO: 90 - DNA, 20 bp, Artificial sequence
  Synthetic oligonucleotide
tagagggaaggatgccaagg

SEQ ID NO: 91 - DNA, 20 bp, Artificial sequence
  Synthetic oligonucleotide
gtgtgtctggagccagtgtg

SEQ ID NO: 92 - DNA, 20 bp, Artificial sequence
  Synthetic oligonucleotide
gaaatcatgggacttgcaag

SEQ ID NO: 93 - DNA, 20 bp, Artificial sequence
  Synthetic oligonucleotide
aaagctaagctaagatgatt

SEQ ID NO: 94 - DNA, 20 bp, Artificial sequence
  Synthetic oligonucleotide
ttacagcaacagtcagtgta

SEQ ID NO: 95 - DNA, 20 bp, Artificial sequence
  Synthetic oligonucleotide
ttgtagactatttgcacctt

SEQ ID NO: 96 - DNA, 20 bp, Artificial sequence
  Synthetic oligonucleotide
tcttcagctttcaggccagc

SEQ ID NO: 97 - DNA, 20 bp, Artificial sequence
  Synthetic oligonucleotide
agaagttttatgaagccgca

SEQ ID NO: 98 - DNA, 20 bp, Artificial sequence
  Synthetic oligonucleotide
cacttcgaactcctggcggg

SEQ ID NO: 99 - DNA, 20 bp, Artificial sequence
  Synthetic oligonucleotide
atcacttcgaactcctggcg

SEQ ID NO: 100 - DNA, 20 bp, Artificial sequence
  Synthetic oligonucleotide
ccatcacttcgaactcctgg

SEQ ID NO: 101 - DNA, 20 bp, Artificial sequence
  Synthetic oligonucleotide
ttccatcacttcgaactcct

SEQ ID NO: 102 - DNA, 20 bp, Artificial sequence
  Synthetic oligonucleotide
tcttccatcacttcgaactc

SEQ ID NO: 103 - DNA, 20 bp, Artificial sequence
  Synthetic oligonucleotide
gatcttccatcacttcgaac

SEQ ID NO: 104 - DNA, 20 bp, Artificial sequence
  Synthetic oligonucleotide
cctgtcccccaacccgtacg

SEQ ID NO: 105 - DNA, 20 bp, Artificial sequence
  Synthetic oligonucleotide
ttcctgtcccccaacccgta

SEQ ID NO: 106 - DNA, 20 bp, Artificial sequence
  Synthetic oligonucleotide
ctttcctgtcccccaacccg

SEQ ID NO: 107 - DNA, 20 bp, Artificial sequence
  Synthetic oligonucleotide
atctttcctgtcccccaacc

SEQ ID NO: 108 - DNA, 20 bp, Artificial sequence
  Synthetic oligonucleotide
tgatctttcctgtcccccaa

SEQ ID NO: 109 - DNA, 20 bp, Artificial sequence
  Synthetic oligonucleotide
cctgatctttcctgtccccc

SEQ ID NO: 110 - DNA, 20 bp, Artificial sequence
  Synthetic oligonucleotide
cccctgatctttcctgtccc

SEQ ID NO: 111 - DNA, 20 bp, Artificial sequence
  Synthetic oligonucleotide
cccccctgatctttcctgtc

SEQ ID NO: 112 - DNA, 20 bp, Artificial sequence
  Synthetic oligonucleotide
agcccccctgatctttcctg

SEQ ID NO: 113 - DNA, 20 bp, Artificial sequence
  Synthetic oligonucleotide
gtagcccccctgatctttcc

SEQ ID NO: 114 - DNA, 20 bp, Artificial sequence
  Synthetic oligonucleotide
gtgtagcccccctgatcttt

SEQ ID NO: 115 - DNA, 20 bp, Artificial sequence
  Synthetic oligonucleotide
tggtgtagcccccctgatct

SEQ ID NO: 116 - DNA, 20 bp, Artificial sequence
  Synthetic oligonucleotide
catggtgtagcccccctgat

SEQ ID NO: 117 - DNA, 20 bp, Artificial sequence
  Synthetic oligonucleotide
tgcatggtgtagcccccctg

SEQ ID NO: 118 - DNA, 20 bp, Artificial sequence
  Synthetic oligonucleotide
ggtgcatggtgtagcccccc

SEQ ID NO: 119 - DNA, 20 bp, Artificial sequence
  Synthetic oligonucleotide
ttggtgcatggtgtagcccc

SEQ ID NO: 120 - DNA, 20 bp, Artificial sequence
  Synthetic oligonucleotide
tcttggtgcatggtgtagcc

SEQ ID NO: 121 - DNA, 20 bp, Artificial sequence
  Synthetic oligonucleotide
ggtcttggtgcatggtgtag

SEQ ID NO: 122 - DNA, 20 bp, Artificial sequence
  Synthetic oligonucleotide
ctcttggtcttggtgcatgg

SEQ ID NO: 123 - DNA, 20 bp, Artificial sequence
  Synthetic oligonucleotide
cgtccgtgtcaccctcttgg

SEQ ID NO: 124 - DNA, 20 bp, Artificial sequence
  Synthetic oligonucleotide
gcttttactgaccatgcgag

SEQ ID NO: 125 - DNA, 20 bp, Artificial sequence
  Synthetic oligonucleotide
ttgcttttactgaccatgcg

SEQ ID NO: 126 - DNA, 20 bp, Artificial sequence
  Synthetic oligonucleotide
ctttgcttttactgaccatg

SEQ ID NO: 127 - DNA, 20 bp, Artificial sequence
  Synthetic oligonucleotide
gtctttgcttttactgacca

SEQ ID NO: 128 - DNA, 20 bp, Artificial sequence
  Synthetic oligonucleotide
ccgtctttgcttttactgac

SEQ ID NO: 129 - DNA, 20 bp, Artificial sequence
  Synthetic oligonucleotide
tcccgtctttgcttttactg

SEQ ID NO: 130 - DNA, 20 bp, Artificial sequence
  Synthetic oligonucleotide
agtcccgtctttgcttttac

SEQ ID NO: 131 - DNA, 20 bp, Artificial sequence
  Synthetic oligonucleotide
ccagtcccgtctttgctttt

SEQ ID NO: 132 - DNA, 20 bp, Artificial sequence
  Synthetic oligonucleotide
gcttccagtcccgtctttgc

SEQ ID NO: 133 - DNA, 20 bp, Artificial sequence
  Synthetic oligonucleotide
tcgcttccagtcccgtcttt

SEQ ID NO: 134 - DNA, 20 bp, Artificial sequence
  Synthetic oligonucleotide
catcgcttccagtcccgtct

SEQ ID NO: 135 - DNA, 20 bp, Artificial sequence
  Synthetic oligonucleotide
gtcatcgcttccagtcccgt

SEQ ID NO: 136 - DNA, 20 bp, Artificial sequence
  Synthetic oligonucleotide
ttgtcatcgcttccagtccc

SEQ ID NO: 137 - DNA, 20 bp, Artificial sequence
  Synthetic oligonucleotide
ttttgtcatcgcttccagtc

SEQ ID NO: 138 - DNA, 20 bp, Artificial sequence
  Synthetic oligonucleotide
ggcccttctggcctggaggg

SEQ ID NO: 139 - DNA, 20 bp, Artificial sequence
  Synthetic oligonucleotide
ctggcccttctggcctggag

SEQ ID NO: 140 - DNA, 20 bp, Artificial sequence
  Synthetic oligonucleotide
gcctggcccttctggcctgg

SEQ ID NO: 141 - DNA, 20 bp, Artificial sequence
  Synthetic oligonucleotide
tggcctggcccttctggcct

SEQ ID NO: 142 - DNA, 20 bp, Artificial sequence
  Synthetic oligonucleotide
gttggcctggcccttctggc

SEQ ID NO: 143 - DNA, 20 bp, Artificial sequence
  Synthetic oligonucleotide
ttttgctggaatcctggtgg

SEQ ID NO: 144 - DNA, 20 bp, Artificial sequence
  Synthetic oligonucleotide
gtttttgctggaatcctggt

SEQ ID NO: 145 - DNA, 20 bp, Artificial sequence
  Synthetic oligonucleotide
gggtttttgctggaatcctg

SEQ ID NO: 146 - DNA, 20 bp, Artificial sequence
  Synthetic oligonucleotide
ggtgtctttggagcgggcgg

SEQ ID NO: 147 - DNA, 20 bp, Artificial sequence
  Synthetic oligonucleotide
gtggtgtctttggagcgggc

SEQ ID NO: 148 - DNA, 20 bp, Artificial sequence
  Synthetic oligonucleotide
gggtggtgtctttggagcgg

SEQ ID NO: 149 - DNA, 20 bp, Artificial sequence
  Synthetic oligonucleotide
ctgggtggtgtctttggagc

SEQ ID NO: 150 - DNA, 20 bp, Artificial sequence
  Synthetic oligonucleotide
agctgggtggtgtctttgga

SEQ ID NO: 151 - DNA, 20 bp, Artificial sequence
  Synthetic oligonucleotide
agagctgggtggtgtctttg

SEQ ID NO: 152 - DNA, 20 bp, Artificial sequence
  Synthetic oligonucleotide
atcccctgattttggaggtt

SEQ ID NO: 153 - DNA, 20 bp, Artificial sequence
  Synthetic oligonucleotide
cgatcccctgattttggagg

SEQ ID NO: 154 - DNA, 20 bp, Artificial sequence
  Synthetic oligonucleotide
tgcgatcccctgattttgga

SEQ ID NO: 155 - DNA, 20 bp, Artificial sequence
  Synthetic oligonucleotide
gctgcgatcccctgattttg

SEQ ID NO: 156 - DNA, 20 bp, Artificial sequence
  Synthetic oligonucleotide
ccgctgcgatcccctgattt

SEQ ID NO: 157 - DNA, 20 bp, Artificial sequence
  Synthetic oligonucleotide
agccgctgcgatcccctgat

SEQ ID NO: 158 - DNA, 20 bp, Artificial sequence
  Synthetic oligonucleotide
gtagccgctgcgatcccctg

SEQ ID NO: 159 - DNA, 20 bp, Artificial sequence
  Synthetic oligonucleotide
cggctgccgggagtgcctgg

SEQ ID NO: 160 - DNA, 20 bp, Artificial sequence
  Synthetic oligonucleotide
agcggctgccgggagtgcct

SEQ ID NO: 161 - DNA, 20 bp, Artificial sequence
  Synthetic oligonucleotide
ggagcggctgccgggagtgc

SEQ ID NO: 162 - DNA, 20 bp, Artificial sequence
  Synthetic oligonucleotide
cgacttgggtggagtacgga

SEQ ID NO: 163 - DNA, 20 bp, Artificial sequence
  Synthetic oligonucleotide
ggcgacttgggtggagtacg

SEQ ID NO: 164 - DNA, 20 bp, Artificial sequence
  Synthetic oligonucleotide
acggcgacttgggtggagta

SEQ ID NO: 165 - DNA, 20 bp, Artificial sequence
  Synthetic oligonucleotide
agacggcgacttgggtggag

SEQ ID NO: 166 - DNA, 20 bp, Artificial sequence
  Synthetic oligonucleotide
gaagacggcgacttgggtgg

SEQ ID NO: 167 - DNA, 20 bp, Artificial sequence
  Synthetic oligonucleotide
cggaagacggcgacttgggt

SEQ ID NO: 168 - DNA, 20 bp, Artificial sequence
  Synthetic oligonucleotide
ggcggaagacggcgacttgg

SEQ ID NO: 169 - DNA, 20 bp, Artificial sequence
  Synthetic oligonucleotide
ttggcggaagacggcgactt

SEQ ID NO: 170 - DNA, 20 bp, Artificial sequence
  Synthetic oligonucleotide
tcttggcggaagacggcgac

SEQ ID NO: 171 - DNA, 20 bp, Artificial sequence
  Synthetic oligonucleotide
gctcttggcggaagacggcg

SEQ ID NO: 172 - DNA, 20 bp, Artificial sequence
  Synthetic oligonucleotide
cggctcttggcggaagacgg

SEQ ID NO: 173 - DNA, 20 bp, Artificial sequence
  Synthetic oligonucleotide
ggcggctcttggcggaagac

SEQ ID NO: 174 - DNA, 20 bp, Artificial sequence
  Synthetic oligonucleotide
gggagattctttcaggccag

SEQ ID NO: 175 - DNA, 20 bp, Artificial sequence
  Synthetic oligonucleotide
gagctttgagttgagggacc

SEQ ID NO: 176 - DNA, 20 bp, Artificial sequence
  Synthetic oligonucleotide
gaccatgcgagctttgagtt

SEQ ID NO: 177 - DNA, 20 bp, Artificial sequence
  Synthetic oligonucleotide
tactgaccatgcgagctttg

SEQ ID NO: 178 - DNA, 20 bp, Artificial sequence
  Synthetic oligonucleotide
atagtcgacagaggcgagga

SEQ ID NO: 179 - DNA, 20 bp, Artificial sequence
  Synthetic oligonucleotide
catcctggttcaaagttcac

SEQ ID NO: 180 - DNA, 20 bp, Artificial sequence
  Synthetic oligonucleotide
ctcagccatcctggttcaaa

SEQ ID NO: 181 - DNA, 20 bp, Artificial sequence
  Synthetic oligonucleotide
gctcagccatcctggttcaa

SEQ ID NO: 182 - DNA, 20 bp, Artificial sequence
  Synthetic oligonucleotide
ggttcctcagatccgtcctc

SEQ ID NO: 183 - DNA, 20 bp, Artificial sequence
  Synthetic oligonucleotide
tgttggagtgctcttagcat

SEQ ID NO: 184 - DNA, 20 bp, Artificial sequence
  Synthetic oligonucleotide
tgcgcggcagcctgcttgcc

SEQ ID NO: 185 - DNA, 20 bp, Artificial sequence
  Synthetic oligonucleotide
accaccttaccactttcagg

SEQ ID NO: 186 - DNA, 20 bp, Artificial sequence
  Synthetic oligonucleotide
gggagccccaggcatgccgg

SEQ ID NO: 187 - DNA, 20 bp, Artificial sequence
  Synthetic oligonucleotide
ttggagaggaaatccacagg

SEQ ID NO: 188 - DNA, 20 bp, Artificial sequence
  Synthetic oligonucleotide
gaaactttggagaggaaatc

SEQ ID NO: 189 - DNA, 20 bp, Artificial sequence
  Synthetic oligonucleotide
ttttactgaccatgcgagct

SEQ ID NO: 190 - DNA, 20 bp, Artificial sequence
  Synthetic oligonucleotide
aaggcaaggcctatttttca

SEQ ID NO: 191 - DNA, 20 bp, Artificial sequence
  Synthetic oligonucleotide
tggatcagagggtctgagct

SEQ ID NO: 192 - DNA, 20 bp, Artificial sequence
  Synthetic oligonucleotide
gtggctctgggcacacagca

SEQ ID NO: 193 - DNA, 20 bp, Artificial sequence
  Synthetic oligonucleotide
ggagtacggaccactgccac

SEQ ID NO: 194 - DNA, 20 bp, Artificial sequence
  Synthetic oligonucleotide
caggcggctcttggcggaag

SEQ ID NO: 195 - DNA, 20 bp, Artificial sequence
  Synthetic oligonucleotide
tgcaggcggctcttggcgga

SEQ ID NO: 196 - DNA, 20 bp, Artificial sequence
  Synthetic oligonucleotide
tctgcaggcggctcttggcg

SEQ ID NO: 197 - DNA, 20 bp, Artificial sequence
  Synthetic oligonucleotide
tggagccgatcttggacttg

SEQ ID NO: 198 - DNA, 20 bp, Artificial sequence
  Synthetic oligonucleotide
agtggagccgatcttggact

SEQ ID NO: 199 - DNA, 20 bp, Artificial sequence
  Synthetic oligonucleotide
ctcagtggagccgatcttgg

SEQ ID NO: 200 - DNA, 20 bp, Artificial sequence
  Synthetic oligonucleotide
ttctcagtggagccgatctt

SEQ ID NO: 201 - DNA, 20 bp, Artificial sequence
  Synthetic oligonucleotide
tcccggctggtgcttcaggt

SEQ ID NO: 202 - DNA, 20 bp, Artificial sequence
  Synthetic oligonucleotide
tttcggacttggcagaggca

SEQ ID NO: 203 - DNA, 20 bp, Artificial sequence
  Synthetic oligonucleotide
gagtgacatgcgccaccctg

SEQ ID NO: 204 - DNA, 20 bp, Artificial sequence
  Synthetic oligonucleotide
ctttcgatgagtgacatgcg

SEQ ID NO: 205 - DNA, 20 bp, Artificial sequence
  Synthetic oligonucleotide
aaaaggatgagtgacacgcc

SEQ ID NO: 206 - DNA, 20 bp, Artificial sequence
  Synthetic oligonucleotide
gtgaaggtactcacactgcc

SEQ ID NO: 207 - DNA, 20 bp, Artificial sequence
  Synthetic oligonucleotide
tgtgaaggtactcacactgc

SEQ ID NO: 208 - DNA, 20 bp, Artificial sequence
  Synthetic oligonucleotide
ctatgcagtgtctcgcaagt

SEQ ID NO: 209 - DNA, 20 bp, Artificial sequence
  Synthetic oligonucleotide
ggatttattctatgcagtgt

SEQ ID NO: 210 - DNA, 20 bp, Artificial sequence
  Synthetic oligonucleotide
aggatttattctatgcagtg

SEQ ID NO: 211 - DNA, 20 bp, Artificial sequence
  Synthetic oligonucleotide
tgagagcccaagaaggattt

SEQ ID NO: 212 - DNA, 20 bp, Artificial sequence
  Synthetic oligonucleotide
cagatcctgagagcccaaga

SEQ ID NO: 213 - DNA, 20 bp, Artificial sequence
  Synthetic oligonucleotide
agccagatcctgagagccca

SEQ ID NO: 214 - DNA, 20 bp, Artificial sequence
  Synthetic oligonucleotide
ggacccagaaatgctgggac

SEQ ID NO: 215 - DNA, 20 bp, Artificial sequence
  Synthetic oligonucleotide
aaatgtgttgtcgaaattct

SEQ ID NO: 216 - DNA, 20 bp, Artificial sequence
  Synthetic oligonucleotide
agtcagggtggaaaaatgtg

SEQ ID NO: 217 - DNA, 20 bp, Artificial sequence
  Synthetic oligonucleotide
agcacatcctagtcagggtg

SEQ ID NO: 218 - DNA, 20 bp, Artificial sequence
  Synthetic oligonucleotide
gccatgaggagcacatccta

SEQ ID NO: 219 - DNA, 20 bp, Artificial sequence
  Synthetic oligonucleotide
gtggttcccagctgccatga

SEQ ID NO: 220 - DNA, 20 bp, Artificial sequence
  Synthetic oligonucleotide
acagtggttcccagctgcca

SEQ ID NO: 221 - DNA, 20 bp, Artificial sequence
  Synthetic oligonucleotide
cccaggcccttattggacag

SEQ ID NO: 222 - DNA, 20 bp, Artificial sequence
  Synthetic oligonucleotide
cttgctcaggtcaactggtt

SEQ ID NO: 223 - DNA, 20 bp, Artificial sequence
  Synthetic oligonucleotide
ggatgttgcctaatgagcca

SEQ ID NO: 224 - DNA, 20 bp, Artificial sequence
  Synthetic oligonucleotide
gtccagggacccaatcttcg

SEQ ID NO: 225 - DNA, 20 bp, Artificial sequence
  Synthetic oligonucleotide
ttgtccagggacccaatctt

SEQ ID NO: 226 - DNA, 20 bp, Artificial sequence
  Synthetic oligonucleotide
aaggtcagcttgtgggtttc

SEQ ID NO: 227 - DNA, 20 bp, Artificial sequence
  Synthetic oligonucleotide
ctccgccccgtggtctgtct

SEQ ID NO: 228 - DNA, 20 bp, Artificial sequence
  Synthetic oligonucleotide
atctccgccccgtggtctgt

SEQ ID NO: 229 - DNA, 20 bp, Artificial sequence
  Synthetic oligonucleotide
cgatctccgccccgtggtct

SEQ ID NO: 230 - DNA, 20 bp, Artificial sequence
  Synthetic oligonucleotide
cacgatctccgccccgtggt

SEQ ID NO: 231 - DNA, 20 bp, Artificial sequence
  Synthetic oligonucleotide
tacacgatctccgccccgtg

SEQ ID NO: 232 - DNA, 20 bp, Artificial sequence
  Synthetic oligonucleotide
tgtacacgatctccgccccg

SEQ ID NO: 233 - DNA, 20 bp, Artificial sequence
  Synthetic oligonucleotide
cttgtacacgatctccgccc

SEQ ID NO: 234 - DNA, 20 bp, Artificial sequence
  Synthetic oligonucleotide
gacttgtacacgatctccgc

SEQ ID NO: 235 - DNA, 20 bp, Artificial sequence
  Synthetic oligonucleotide
gcgacttgtacacgatctcc

SEQ ID NO: 236 - DNA, 20 bp, Artificial sequence
  Synthetic oligonucleotide
tggcgacttgtacacgatct

SEQ ID NO: 237 - DNA, 20 bp, Artificial sequence
  Synthetic oligonucleotide
actggcgacttgtacacgat

SEQ ID NO: 238 - DNA, 20 bp, Artificial sequence
  Synthetic oligonucleotide
ccactggcgacttgtacacg

SEQ ID NO: 239 - DNA, 20 bp, Artificial sequence
  Synthetic oligonucleotide
cagacaccactggcgacttg

SEQ ID NO: 240 - DNA, 20 bp, Artificial sequence
  Synthetic oligonucleotide
gctgccggtggaggagacat

SEQ ID NO: 241 - DNA, 20 bp, Artificial sequence
  Synthetic oligonucleotide
tgctgccggtggaggagaca

SEQ ID NO: 242 - DNA, 20 bp, Artificial sequence
  Synthetic oligonucleotide
tgtcgatgctgccggtggag

SEQ ID NO: 243 - DNA, 20 bp, Artificial sequence
  Synthetic oligonucleotide
atgtcgatgctgccggtgga

SEQ ID NO: 244 - DNA, 20 bp, Artificial sequence
  Synthetic oligonucleotide
gagtctaccatgtcgatgct

SEQ ID NO: 245 - DNA, 20 bp, Artificial sequence
  Synthetic oligonucleotide
ccagggaggcagacacctcg

SEQ ID NO: 246 - DNA, 20 bp, Artificial sequence
  Synthetic oligonucleotide
ctgcttggccagggaggcag

SEQ ID NO: 247 - DNA, 20 bp, Artificial sequence
  Synthetic oligonucleotide
tgatcacaaaccctgcttgg

SEQ ID NO: 248 - DNA, 20 bp, Artificial sequence
  Synthetic oligonucleotide
ccgaactgcgaggagcagct

SEQ ID NO: 249 - DNA, 20 bp, Artificial sequence
  Synthetic oligonucleotide
tgcttacacaccacacacac

SEQ ID NO: 250 - DNA, 20 bp, Artificial sequence
  Synthetic oligonucleotide
atgcttacacaccacacaca

SEQ ID NO: 251 - DNA, 20 bp, Artificial sequence
  Synthetic oligonucleotide
catgcttacacaccacacac

SEQ ID NO: 252 - DNA, 20 bp, Artificial sequence
  Synthetic oligonucleotide
tacagatatatgattggatg

SEQ ID NO: 253 - DNA, 20 bp, Artificial sequence
  Synthetic oligonucleotide
gtacagatatatgattggat

SEQ ID NO: 254 - DNA, 20 bp, Artificial sequence
  Synthetic oligonucleotide
tgtacagatatatgattgga

SEQ ID NO: 255 - DNA, 20 bp, Artificial sequence
  Synthetic oligonucleotide
atgtacagatatatgattgg

SEQ ID NO: 256 - DNA, 20 bp, Artificial sequence
  Synthetic oligonucleotide
tatgtacagatatatgattg

SEQ ID NO: 257 - DNA, 20 bp, Artificial sequence
  Synthetic oligonucleotide
ttatgtacagatatatgatt

SEQ ID NO: 258 - DNA, 20 bp, Artificial sequence
  Synthetic oligonucleotide
attatgtacagatatatgat

SEQ ID NO: 259 - DNA, 20 bp, Artificial sequence
  Synthetic oligonucleotide
gattatgtacagatatatga

SEQ ID NO: 260 - DNA, 20 bp, Artificial sequence
  Synthetic oligonucleotide
ggattatgtacagatatatg

SEQ ID NO: 261 - DNA, 20 bp, Artificial sequence
  Synthetic oligonucleotide
tggattatgtacagatatat

SEQ ID NO: 262 - DNA, 20 bp, Artificial sequence
  Synthetic oligonucleotide
atggattatgtacagatata

SEQ ID NO: 263 - DNA, 20 bp, Artificial sequence
  Synthetic oligonucleotide
aatggattatgtacagatat

SEQ ID NO: 264 - DNA, 20 bp, Artificial sequence
  Synthetic oligonucleotide
gaatggattatgtacagata

SEQ ID NO: 265 - DNA, 20 bp, Artificial sequence
  Synthetic oligonucleotide
agaatggattatgtacagat

SEQ ID NO: 266 - DNA, 20 bp, Artificial sequence
  Synthetic oligonucleotide
aagaatggattatgtacaga

SEQ ID NO: 267 - DNA, 20 bp, Artificial sequence
  Synthetic oligonucleotide
gaagaatggattatgtacag

SEQ ID NO: 268 - DNA, 20 bp, Artificial sequence
  Synthetic oligonucleotide
ggaagaatggattatgtaca

SEQ ID NO: 269 - DNA, 20 bp, Artificial sequence
  Synthetic oligonucleotide
gggaagaatggattatgtac

SEQ ID NO: 270 - DNA, 20 bp, Artificial sequence
  Synthetic oligonucleotide
agggaagaatggattatgta

SEQ ID NO: 271 - DNA, 20 bp, Artificial sequence
  Synthetic oligonucleotide
gagggaagaatggattatgt

SEQ ID NO: 272 - DNA, 20 bp, Artificial sequence
  Synthetic oligonucleotide
cgagggaagaatggattatg

SEQ ID NO: 273 - DNA, 20 bp, Artificial sequence
  Synthetic oligonucleotide
ccgagggaagaatggattat

SEQ ID NO: 274 - DNA, 20 bp, Artificial sequence
  Synthetic oligonucleotide
accgagggaagaatggatta

SEQ ID NO: 275 - DNA, 20 bp, Artificial sequence
  Synthetic oligonucleotide
aaccgagggaagaatggatt

SEQ ID NO: 276 - DNA, 20 bp, Artificial sequence
  Synthetic oligonucleotide
gaaccgagggaagaatggat

SEQ ID NO: 277 - DNA, 20 bp, Artificial sequence
  Synthetic oligonucleotide
tgaaccgagggaagaatgga

SEQ ID NO: 278 - DNA, 20 bp, Artificial sequence
  Synthetic oligonucleotide
atgaaccgagggaagaatgg

SEQ ID NO: 279 - DNA, 20 bp, Artificial sequence
  Synthetic oligonucleotide
gatgaaccgagggaagaatg

SEQ ID NO: 280 - DNA, 20 bp, Artificial sequence
  Synthetic oligonucleotide
ggatgaaccgagggaagaat

SEQ ID NO: 281 - DNA, 20 bp, Artificial sequence
  Synthetic oligonucleotide
tggatgaaccgagggaagaa

SEQ ID NO: 282 - DNA, 20 bp, Artificial sequence
  Synthetic oligonucleotide
atggatgaaccgagggaaga

SEQ ID NO: 283 - DNA, 20 bp, Artificial sequence
  Synthetic oligonucleotide
gatggatgaaccgagggaag

SEQ ID NO: 284 - DNA, 20 bp, Artificial sequence
  Synthetic oligonucleotide
ggatggatgaaccgagggaa

SEQ ID NO: 285 - DNA, 20 bp, Artificial sequence
  Synthetic oligonucleotide
tggatggatgaaccgaggga

SEQ ID NO: 286 - DNA, 20 bp, Artificial sequence
  Synthetic oligonucleotide
atggatggatgaaccgaggg

SEQ ID NO: 287 - DNA, 20 bp, Artificial sequence
  Synthetic oligonucleotide
gatggatggatgaaccgagg

SEQ ID NO: 288 - DNA, 20 bp, Artificial sequence
  Synthetic oligonucleotide
ggatggatggatgaaccgag

SEQ ID NO: 289 - DNA, 20 bp, Artificial sequence
  Synthetic oligonucleotide
aaggatgaaggaagggatgg

SEQ ID NO: 290 - DNA, 20 bp, Artificial sequence
  Synthetic oligonucleotide
gaaggatgaaggaagggatg

SEQ ID NO: 291 - DNA, 20 bp, Artificial sequence
  Synthetic oligonucleotide
ggaaggatgaaggaagggat

SEQ ID NO: 292 - DNA, 20 bp, Artificial sequence
  Synthetic oligonucleotide
taggaaggatgaaggaaggg

SEQ ID NO: 293 - DNA, 20 bp, Artificial sequence
  Synthetic oligonucleotide
ataggaaggatgaaggaagg

SEQ ID NO: 294 - DNA, 20 bp, Artificial sequence
  Synthetic oligonucleotide
gataggaaggatgaaggaag

SEQ ID NO: 295 - DNA, 20 bp, Artificial sequence
  Synthetic oligonucleotide
tgataggaaggatgaaggaa

SEQ ID NO: 296 - DNA, 20 bp, Artificial sequence
  Synthetic oligonucleotide
atgataggaaggatgaagga

SEQ ID NO: 297 - DNA, 20 bp, Artificial sequence
  Synthetic oligonucleotide
gatgataggaaggatgaagg

SEQ ID NO: 298 - DNA, 20 bp, Artificial sequence
  Synthetic oligonucleotide
ggatgataggaaggatgaag

SEQ ID NO: 299 - DNA, 20 bp, Artificial sequence
  Synthetic oligonucleotide
tggatgataggaaggatgaa

SEQ ID NO: 300 - DNA, 20 bp, Artificial sequence
  Synthetic oligonucleotide
atggatgataggaaggatga

SEQ ID NO: 301 - DNA, 20 bp, Artificial sequence
  Synthetic oligonucleotide
gatggatgataggaaggatg

SEQ ID NO: 302 - DNA, 20 bp, Artificial sequence
  Synthetic oligonucleotide
ggatggatgataggaaggat

SEQ ID NO: 303 - DNA, 20 bp, Artificial sequence
  Synthetic oligonucleotide
tggatggatgataggaagga

SEQ ID NO: 304 - DNA, 20 bp, Artificial sequence
  Synthetic oligonucleotide
ttggatggatgataggaagg

SEQ ID NO: 305 - DNA, 20 bp, Artificial sequence
  Synthetic oligonucleotide
attggatggatgataggaag

SEQ ID NO: 306 - DNA, 20 bp, Artificial sequence
  Synthetic oligonucleotide
gattggatggatgataggaa

SEQ ID NO: 307 - DNA, 20 bp, Artificial sequence
  Synthetic oligonucleotide
tgattggatggatgatagga

SEQ ID NO: 308 - DNA, 20 bp, Artificial sequence
  Synthetic oligonucleotide
atgattggatggatgatagg

SEQ ID NO: 309 - DNA, 20 bp, Artificial sequence
  Synthetic oligonucleotide
tatgattggatggatgatag

SEQ ID NO: 310 - DNA, 20 bp, Artificial sequence
  Synthetic oligonucleotide
agatatgggtggatggatgg

SEQ ID NO: 311 - DNA, 20 bp, Artificial sequence
  Synthetic oligonucleotide
aagatatgggtggatggatg

SEQ ID NO: 312 - DNA, 20 bp, Artificial sequence
  Synthetic oligonucleotide
gaagatatgggtggatggat

SEQ ID NO: 313 - DNA, 20 bp, Artificial sequence
  Synthetic oligonucleotide
acacaccttcatttactgtc

SEQ ID NO: 314 - DNA, 20 bp, Artificial sequence
  Synthetic oligonucleotide
aacacaccttcatttactgt

SEQ ID NO: 315 - DNA, 20 bp, Artificial sequence
  Synthetic oligonucleotide
aaacacaccttcatttactg

SEQ ID NO: 316 - DNA, 20 bp, Artificial sequence
  Synthetic oligonucleotide
caaacacaccttcatttact

SEQ ID NO: 317 - DNA, 20 bp, Artificial sequence
  Synthetic oligonucleotide
tcaaacacaccttcatttac

SEQ ID NO: 318 - DNA, 20 bp, Artificial sequence
  Synthetic oligonucleotide
tttcaaacacaccttcattt

SEQ ID NO: 319 - DNA, 20 bp, Artificial sequence
  Synthetic oligonucleotide
ttttcaaacacaccttcatt

SEQ ID NO: 320 - DNA, 20 bp, Artificial sequence
  Synthetic oligonucleotide
gttttcaaacacaccttcat

SEQ ID NO: 321 - DNA, 20 bp, Artificial sequence
  Synthetic oligonucleotide
ggttttcaaacacaccttca

SEQ ID NO: 322 - DNA, 20 bp, Artificial sequence
  Synthetic oligonucleotide
tggttttcaaacacaccttc

SEQ ID NO: 323 - DNA, 20 bp, Artificial sequence
  Synthetic oligonucleotide
gaaaacagagaaaagcacaa

SEQ ID NO: 324 - DNA, 20 bp, Artificial sequence
  Synthetic oligonucleotide
agaagtgatatcatatccta

SEQ ID NO: 325 - DNA, 20 bp, Artificial sequence
  Synthetic oligonucleotide
aagaagtgatatcatatcct

SEQ ID NO: 326 - DNA, 20 bp, Artificial sequence
  Synthetic oligonucleotide
cttcagctttcaggccagcg

SEQ ID NO: 327 - DNA, 20 bp, Artificial sequence
  Synthetic oligonucleotide
ccatgcgagcttgggtcacg

SEQ ID NO: 328 - DNA, 20 bp, Artificial sequence
  Synthetic oligonucleotide
cagcccccttggcttttttg

SEQ ID NO: 329 - DNA, 20 bp, Artificial sequence
  Synthetic oligonucleotide
ttgcaccttcccgcctcccg

SEQ ID NO: 330 - DNA, 20 bp, Artificial sequence
  Synthetic oligonucleotide
tgccgctcggccgtccggcg

SEQ ID NO: 331 - DNA, 20 bp, Artificial sequence
  Synthetic oligonucleotide
gcccggcgcacgaagcccca

SEQ ID NO: 332 - DNA, 20 bp, Artificial sequence
  Synthetic oligonucleotide
agaaagaaatccgccccgag

SEQ ID NO: 333 - DNA, 20 bp, Artificial sequence
  Synthetic oligonucleotide
ataatggaatacttattgca

SEQ ID NO: 334 - DNA, 20 bp, Artificial sequence
  Synthetic oligonucleotide
gcaggagcatggcacctgga

SEQ ID NO: 335 - DNA, 20 bp, Artificial sequence
  Synthetic oligonucleotide
actcgctgacatggtgtttg

SEQ ID NO: 336 - DNA, 20 bp, Artificial sequence
  Synthetic oligonucleotide
gatgactccacaatgtaaac

SEQ ID NO: 337 - DNA, 20 bp, Artificial sequence
  Synthetic oligonucleotide
cctataggattatccaggaa

SEQ ID NO: 338 - DNA, 20 bp, Artificial sequence
  Synthetic oligonucleotide
catttctcatcagccatcga

SEQ ID NO: 339 - DNA, 20 bp, Artificial sequence
  Synthetic oligonucleotide
accaaagacttcagatcagc

SEQ ID NO: 340 - DNA, 20 bp, Artificial sequence
  Synthetic oligonucleotide
agcttctgggagctgcagat

SEQ ID NO: 341 - DNA, 20 bp, Artificial sequence
  Synthetic oligonucleotide
agaggaacccagtctgaggg

SEQ ID NO: 342 - DNA, 20 bp, Artificial sequence
  Synthetic oligonucleotide
aggctgcgctgcccctccag

SEQ ID NO: 343 - DNA, 20 bp, Artificial sequence
  Synthetic oligonucleotide
aatccctgctgtggtcgcag

SEQ ID NO: 344 - DNA, 20 bp, Artificial sequence
  Synthetic oligonucleotide
tctagagcagatccaggaca

SEQ ID NO: 345 - DNA, 20 bp, Artificial sequence
  Synthetic oligonucleotide
aagtcatccttcctcaggca

SEQ ID NO: 346 - DNA, 20 bp, Artificial sequence
  Synthetic oligonucleotide
caaggctttgggaacagtgt

SEQ ID NO: 347 - DNA, 20 bp, Artificial sequence
  Synthetic oligonucleotide
gtcaaggctttgggaacagt

SEQ ID NO: 348 - DNA, 20 bp, Artificial sequence
  Synthetic oligonucleotide
ttgtgcaaggtcagcgggct

SEQ ID NO: 349 - DNA, 20 bp, Artificial sequence
  Synthetic oligonucleotide
cggcttcccttttctcatgg

SEQ ID NO: 350 - DNA, 20 bp, Artificial sequence
  Synthetic oligonucleotide
tgagtttctttaggcagcaa

SEQ ID NO: 351 - DNA, 20 bp, Artificial sequence
  Synthetic oligonucleotide
aaccagaagtggcagaattg

SEQ ID NO: 352 - DNA, 20 bp, Artificial sequence
  Synthetic oligonucleotide
caagtccctcagggttgcct

SEQ ID NO: 353 - DNA, 20 bp, Artificial sequence
  Synthetic oligonucleotide
cgaagctgccagccccaggg

SEQ ID NO: 354 - DNA, 20 bp, Artificial sequence
  Synthetic oligonucleotide
agacttcctttcaggtaaag

SEQ ID NO: 355 - DNA, 20 bp, Artificial sequence
  Synthetic oligonucleotide
agggaggctcttggtggaga

SEQ ID NO: 356 - DNA, 20 bp, Artificial sequence
  Synthetic oligonucleotide
acttaggagaattgctggga

SEQ ID NO: 357 - DNA, 20 bp, Artificial sequence
  Synthetic oligonucleotide
cccacatttccttctccttc

SEQ ID NO: 358 - DNA, 20 bp, Artificial sequence
  Synthetic oligonucleotide
actgttggcagtaatgaggg

SEQ ID NO: 359 - DNA, 20 bp, Artificial sequence
  Synthetic oligonucleotide
ggaagaggaaccgaggtgcg

SEQ ID NO: 360 - DNA, 20 bp, Artificial sequence
  Synthetic oligonucleotide
catggtgctgaagagcaggg

SEQ ID NO: 361 - DNA, 20 bp, Artificial sequence
  Synthetic oligonucleotide
gggagatcccagagccttcc

SEQ ID NO: 362 - DNA, 20 bp, Artificial sequence
  Synthetic oligonucleotide
cttaggctggccccaagagc

SEQ ID NO: 363 - DNA, 20 bp, Artificial sequence
  Synthetic oligonucleotide
tatctgccagcactgatcac

SEQ ID NO: 364 - DNA, 20 bp, Artificial sequence
  Synthetic oligonucleotide
tttaagatcacaagccagcg

SEQ ID NO: 365 - DNA, 20 bp, Artificial sequence
  Synthetic oligonucleotide
gaggagtgcccagccctggg

SEQ ID NO: 366 - DNA, 20 bp, Artificial sequence
  Synthetic oligonucleotide
ctggctctgcaggtgggaga

SEQ ID NO: 367 - DNA, 20 bp, Artificial sequence
  Synthetic oligonucleotide
tacagtatatcctatctagc

SEQ ID NO: 368 - DNA, 20 bp, Artificial sequence
  Synthetic oligonucleotide
ataaagtgagtcagcagctt

SEQ ID NO: 369 - DNA, 20 bp, Artificial sequence
  Synthetic oligonucleotide
tcaccactgaagtcaattta

SEQ ID NO: 370 - DNA, 20 bp, Artificial sequence
  Synthetic oligonucleotide
agcacaacaagcaatagcaa

SEQ ID NO: 371 - DNA, 20 bp, Artificial sequence
  Synthetic oligonucleotide
actatcttacacattcctcc

SEQ ID NO: 372 - DNA, 20 bp, Artificial sequence
  Synthetic oligonucleotide
gctgcaccccaagatctccc

SEQ ID NO: 373 - DNA, 20 bp, Artificial sequence
  Synthetic oligonucleotide
aaatcatgaaaagggttacg

SEQ ID NO: 374 - DNA, 20 bp, Artificial sequence
  Synthetic oligonucleotide
gtggctgctccctccctcta

SEQ ID NO: 375 - DNA, 20 bp, Artificial sequence
  Synthetic oligonucleotide
cccaagggcctctaactccg

SEQ ID NO: 376 - DNA, 20 bp, Artificial sequence
  Synthetic oligonucleotide
tggaaaagagaaaccccaag

SEQ ID NO: 377 - DNA, 20 bp, Artificial sequence
  Synthetic oligonucleotide
tgaactagccagctgcctgg

SEQ ID NO: 378 - DNA, 20 bp, Artificial sequence
  Synthetic oligonucleotide
tattcctacgcctgcacctg

SEQ ID NO: 379 - DNA, 20 bp, Artificial sequence
  Synthetic oligonucleotide
agagggcagcaggccaaagc

SEQ ID NO: 380 - DNA, 20 bp, Artificial sequence
  Synthetic oligonucleotide
ttagggaggcatgattgtgg

SEQ ID NO: 381 - DNA, 20 bp, Artificial sequence
  Synthetic oligonucleotide
ccaacggcttagagggaagg

SEQ ID NO: 382 - DNA, 20 bp, Artificial sequence
  Synthetic oligonucleotide
tgccaacggcttagagggaa

SEQ ID NO: 383 - DNA, 20 bp, Artificial sequence
  Synthetic oligonucleotide
tgtctggagccagtgtgaga

SEQ ID NO: 384 - DNA, 20 bp, Artificial sequence
  Synthetic oligonucleotide
cgagtgatctcagctccaaa

SEQ ID NO: 385 - DNA, 20 bp, Artificial sequence
  Synthetic oligonucleotide
tgatcacctctgccctcgcc

SEQ ID NO: 386 - DNA, 20 bp, Artificial sequence
  Synthetic oligonucleotide
tgaagctgcaggtctgtaga

SEQ ID NO: 387 - DNA, 20 bp, Artificial sequence
  Synthetic oligonucleotide
cttttcaaagctgaagagaa

SEQ ID NO: 388 - DNA, 20 bp, Artificial sequence
  Synthetic oligonucleotide
aggtgaggctctaggccagt

SEQ ID NO: 389 - DNA, 20 bp, Artificial sequence
  Synthetic oligonucleotide
caacatggcaaactcatggg

SEQ ID NO: 390 - DNA, 20 bp, Artificial sequence
  Synthetic oligonucleotide
atgggacttgcaagtgccag

SEQ ID NO: 391 - DNA, 20 bp, Artificial sequence
  Synthetic oligonucleotide
cctccccccaccctcagaat

SEQ ID NO: 392 - DNA, 20 bp, Artificial sequence
  Synthetic oligonucleotide
agacagaaagctaagctaag

SEQ ID NO: 393 - DNA, 20 bp, Artificial sequence
  Synthetic oligonucleotide
ttaaaacacacaatacacta

SEQ ID NO: 394 - DNA, 20 bp, Artificial sequence
  Synthetic oligonucleotide
acttttacagcaacagtcag

SEQ ID NO: 395 - DNA, 20 bp, Artificial sequence
  Synthetic oligonucleotide
tttaatcagagtaataactt

SEQ ID NO: 396 - DNA, 20 bp, Artificial sequence
  Synthetic oligonucleotide
tgcccttcgcggtcccttcg

SEQ ID NO: 397 - DNA, 20 bp, Artificial sequence
  Synthetic oligonucleotide
ctgtcccccaaacccgtacg

SEQ ID NO: 398 - DNA, 20 bp, Artificial sequence
  Synthetic oligonucleotide
gcttccgctgttggagtgct

SEQ ID NO: 399 - DNA, 20 bp, Artificial sequence
  Synthetic oligonucleotide
gccctgccgctcggccgtcc

SEQ ID NO: 400 - DNA, 20 bp, Artificial sequence
  Synthetic oligonucleotide
ttctcctccggccactagtg

SEQ ID NO: 401 - DNA, 20 bp, Artificial sequence
  Synthetic oligonucleotide
gaacgcgagcctccccaggg

SEQ ID NO: 402 - DNA, 20 bp, Artificial sequence
  Synthetic oligonucleotide
gaggccggcgggcggcgcag

SEQ ID NO: 403 - DNA, 20 bp, Artificial sequence
  Synthetic oligonucleotide
gagggcgcgcgccggcgaag

SEQ ID NO: 404 - DNA, 20 bp, Artificial sequence
  Synthetic oligonucleotide
ttggtgccggagctggtggg

SEQ ID NO: 405 - DNA, 20 bp, Artificial sequence
  Synthetic oligonucleotide
ggcagaaggtgggcggtggc

SEQ ID NO: 406 - DNA, 20 bp, Artificial sequence
  Synthetic oligonucleotide
tgatagtcgacagaggcgag

SEQ ID NO: 407 - DNA, 20 bp, Artificial sequence
  Synthetic oligonucleotide
gtcttggtgcatggtgtagc

SEQ ID NO: 408 - DNA, 20 bp, Artificial sequence
  Synthetic oligonucleotide
cctcagatccgtcctcagtg

SEQ ID NO: 409 - DNA, 20 bp, Artificial sequence
  Synthetic oligonucleotide
tgctcttagcatcagaggtt

SEQ ID NO: 410 - DNA, 20 bp, Artificial sequence
  Synthetic oligonucleotide
ctaagggtgctgtcacatct

SEQ ID NO: 411 - DNA, 20 bp, Artificial sequence
  Synthetic oligonucleotide
cggcagcctgcttgccggga

SEQ ID NO: 412 - DNA, 20 bp, Artificial sequence
  Synthetic oligonucleotide
tggttccttctgggatctcc

SEQ ID NO: 413 - DNA, 20 bp, Artificial sequence
  Synthetic oligonucleotide
ctcggaggaagccttcctgg

SEQ ID NO: 414 - DNA, 20 bp, Artificial sequence
  Synthetic oligonucleotide
tgagctggtggctcagacct

SEQ ID NO: 415 - DNA, 20 bp, Artificial sequence
  Synthetic oligonucleotide
cctgtccccgaaggttggcg

SEQ ID NO: 416 - DNA, 20 bp, Artificial sequence
  Synthetic oligonucleotide
ggtgcttgagcagctcaggg

SEQ ID NO: 417 - DNA, 20 bp, Artificial sequence
  Synthetic oligonucleotide
gcggcccctcctggtgcagg

SEQ ID NO: 418 - DNA, 20 bp, Artificial sequence
  Synthetic oligonucleotide
ccggcctctctttgccccct

SEQ ID NO: 419 - DNA, 20 bp, Artificial sequence
  Synthetic oligonucleotide
cgtcgcggtcttcatccacc

SEQ ID NO: 420 - DNA, 20 bp, Artificial sequence
  Synthetic oligonucleotide
ggccgcccatcttgggctgg

SEQ ID NO: 421 - DNA, 20 bp, Artificial sequence
  Synthetic oligonucleotide
atgctggtggcttctctggc

SEQ ID NO: 422 - DNA, 20 bp, Artificial sequence
  Synthetic oligonucleotide
atggcaccctccgctgggaa

SEQ ID NO: 423 - DNA, 20 bp, Artificial sequence
  Synthetic oligonucleotide
gctctgaggctgggatctct

SEQ ID NO: 424 - DNA, 20 bp, Artificial sequence
  Synthetic oligonucleotide
gccctttggcccgccctaca

SEQ ID NO: 425 - DNA, 20 bp, Artificial sequence
  Synthetic oligonucleotide
cgttgggtgtgatttccacg

SEQ ID NO: 426 - DNA, 20 bp, Artificial sequence
  Synthetic oligonucleotide
aatgctcctccgagtgcgcc

SEQ ID NO: 427 - DNA, 20 bp, Artificial sequence
  Synthetic oligonucleotide
cctctggcccctctccaggg

SEQ ID NO: 428 - DNA, 20 bp, Artificial sequence
  Synthetic oligonucleotide
cttttgtgtcctctcccaaa

SEQ ID NO: 429 - DNA, 20 bp, Artificial sequence
  Synthetic oligonucleotide
gctgcttttcagagggctct

SEQ ID NO: 430 - DNA, 20 bp, Artificial sequence
  Synthetic oligonucleotide
ggctgacgggcttcccccgc

SEQ ID NO: 431 - DNA, 20 bp, Artificial sequence
  Synthetic oligonucleotide
tttgagttgagggacccggc

SEQ ID NO: 432 - DNA, 20 bp, Artificial sequence
  Synthetic oligonucleotide
tctgagctaccaggagtggg

SEQ ID NO: 433 - DNA, 20 bp, Artificial sequence
  Synthetic oligonucleotide
gcacacagcagggctggagg

SEQ ID NO: 434 - DNA, 20 bp, Artificial sequence
  Synthetic oligonucleotide
gggaagtgacagaagagacg

SEQ ID NO: 435 - DNA, 20 bp, Artificial sequence
  Synthetic oligonucleotide
gtttcatctcctttgctcca

SEQ ID NO: 436 - DNA, 20 bp, Artificial sequence
  Synthetic oligonucleotide
ccgcggtgtggcgatcttcg

SEQ ID NO: 437 - DNA, 20 bp, Artificial sequence
  Synthetic oligonucleotide
ggcctggcccttctggcctg

SEQ ID NO: 438 - DNA, 20 bp, Artificial sequence
  Synthetic oligonucleotide
cttctctggacttgcttagt

SEQ ID NO: 439 - DNA, 20 bp, Artificial sequence
  Synthetic oligonucleotide
ctctcagatctgggccctgc

SEQ ID NO: 440 - DNA, 20 bp, Artificial sequence
  Synthetic oligonucleotide
cctctctcagatctgggccc

SEQ ID NO: 441 - DNA, 20 bp, Artificial sequence
  Synthetic oligonucleotide
tagccgctgcgatcccctga

SEQ ID NO: 442 - DNA, 20 bp, Artificial sequence
  Synthetic oligonucleotide
ccaccttcttgggctcccgg

SEQ ID NO: 443 - DNA, 20 bp, Artificial sequence
  Synthetic oligonucleotide
caggtctggcatgggcacgg

SEQ ID NO: 444 - DNA, 20 bp, Artificial sequence
  Synthetic oligonucleotide
caccttcccgcctcccggct

SEQ ID NO: 445 - DNA, 20 bp, Artificial sequence
  Synthetic oligonucleotide
gttgctaagatccagcttct

SEQ ID NO: 446 - DNA, 20 bp, Artificial sequence
  Synthetic oligonucleotide
gatattatcctttgagccac

SEQ ID NO: 447 - DNA, 20 bp, Artificial sequence
  Synthetic oligonucleotide
ggtcaccttgctcaggtcaa

SEQ ID NO: 448 - DNA, 20 bp, Artificial sequence
  Synthetic oligonucleotide
atgatggatgttgcctaatg

SEQ ID NO: 449 - DNA, 20 bp, Artificial sequence
  Synthetic oligonucleotide
gagattctttcaggccagcg

SEQ ID NO: 450 - DNA, 20 bp, Artificial sequence
  Synthetic oligonucleotide
tttcaggctcttgggtcacg

SEQ ID NO: 451 - DNA, 20 bp, Artificial sequence
  Synthetic oligonucleotide
gctttgagttgagggacccg

SEQ ID NO: 452 - DNA, 20 bp, Artificial sequence
  Synthetic oligonucleotide
tatttgcacactgccgcctc

SEQ ID NO: 453 - DNA, 20 bp, Artificial sequence
  Synthetic oligonucleotide
agattttacttccacctggc

SEQ ID NO: 454 - DNA, 20 bp, Artificial sequence
  Synthetic oligonucleotide
cgactggactctgtccttga

SEQ ID NO: 455 - DNA, 20 bp, Artificial sequence
  Synthetic oligonucleotide
tatttcctccgccagggacg

SEQ ID NO: 456 - DNA, 20 bp, Artificial sequence
  Synthetic oligonucleotide
cgcggaaggtcagcttgtgg

SEQ ID NO: 457 - DNA, 20 bp, Artificial sequence
  Synthetic oligonucleotide
ccgccccgtggtctgtcttg

SEQ ID NO: 458 - DNA, 20 bp, Artificial sequence
  Synthetic oligonucleotide
ccccagacaccactggcgac

SEQ ID NO: 459 - DNA, 20 bp, Artificial sequence
  Synthetic oligonucleotide
gccggtggaggagacattgc

SEQ ID NO: 460 - DNA, 20 bp, Artificial sequence
  Synthetic oligonucleotide
aattattgaccgccccaggg

SEQ ID NO: 461 - DNA, 20 bp, Artificial sequence
  Synthetic oligonucleotide
tttttccacactctctcatt

SEQ ID NO: 462 - DNA, 20 bp, Artificial sequence
  Synthetic oligonucleotide
aactgcgaggagcagctggg

SEQ ID NO: 463 - DNA, 20 bp, Artificial sequence
  Synthetic oligonucleotide
caaaagcaggttaagtgatt

SEQ ID NO: 464 - DNA, 20 bp, Artificial sequence
  Synthetic oligonucleotide
ctgattttgaagtcccgagc

SEQ ID NO: 465 - DNA, 20 bp, Artificial sequence
  Synthetic oligonucleotide
atttgctcttactcccatca

SEQ ID NO: 466 - DNA, 20 bp, Artificial sequence
  Synthetic oligonucleotide
ttggaaagatgaaatttgct

SEQ ID NO: 467 - DNA, 20 bp, Artificial sequence
  Synthetic oligonucleotide
tgttggatgtggccatgttt

SEQ ID NO: 468 - DNA, 20 bp, Artificial sequence
  Synthetic oligonucleotide
gtcccttgaaatcccccaga

SEQ ID NO: 469 - DNA, 20 bp, Artificial sequence
  Synthetic oligonucleotide
ccacaacagggccagaggtg

SEQ ID NO: 470 - DNA, 20 bp, Artificial sequence
  Synthetic oligonucleotide
tcctttgttgctgccactgc

SEQ ID NO: 471 - DNA, 20 bp, Artificial sequence
  Synthetic oligonucleotide
gcctgtggctccacgaacac

SEQ ID NO: 472 - DNA, 20 bp, Artificial sequence
  Synthetic oligonucleotide
ccccgtcacactcacacaag

SEQ ID NO: 473 - DNA, 20 bp, Artificial sequence
  Synthetic oligonucleotide
ggcctcccccgtggcctccc

SEQ ID NO: 474 - DNA, 20 bp, Artificial sequence
  Synthetic oligonucleotide
tgcttcctctcccctctgcc

SEQ ID NO: 475 - DNA, 20 bp, Artificial sequence
  Synthetic oligonucleotide
gatgtctactctccagcacg

SEQ ID NO: 476 - DNA, 20 bp, Artificial sequence
  Synthetic oligonucleotide
ataggccttggctctcccag

SEQ ID NO: 477 - DNA, 20 bp, Artificial sequence
  Synthetic oligonucleotide
aggacaggcggccgctcaga

SEQ ID NO: 478 - DNA, 20 bp, Artificial sequence
  Synthetic oligonucleotide
tgacccacagcaggccccca

SEQ ID NO: 479 - DNA, 20 bp, Artificial sequence
  Synthetic oligonucleotide
ctcccacaggctgccctgca

SEQ ID NO: 480 - DNA, 20 bp, Artificial sequence
  Synthetic oligonucleotide
cagcttgccttctcttttta

SEQ ID NO: 481 - DNA, 20 bp, Artificial sequence
  Synthetic oligonucleotide
aaggaggtcatccacgaagt

SEQ ID NO: 482 - DNA, 20 bp, Artificial sequence
  Synthetic oligonucleotide
gacatcaaggtcagtctttt

SEQ ID NO: 483 - DNA, 20 bp, Artificial sequence
  Synthetic oligonucleotide
agggaggaagaggccagcgc

SEQ ID NO: 484 - DNA, 20 bp, Artificial sequence
  Synthetic oligonucleotide
agcccctcaactcaggcccc

SEQ ID NO: 485 - DNA, 20 bp, Artificial sequence
  Synthetic oligonucleotide
tcaataaaacagggtttctg

SEQ ID NO: 486 - DNA, 20 bp, Artificial sequence
  Synthetic oligonucleotide
caaaatcatggcagcagttc

SEQ ID NO: 487 - DNA, 20 bp, Artificial sequence
  Synthetic oligonucleotide
gttagccctaaagtcccagg

SEQ ID NO: 488 - DNA, 20 bp, Artificial sequence
  Synthetic oligonucleotide
cccaagaggcacaagtcctt

SEQ ID NO: 489 - DNA, 20 bp, Artificial sequence
  Synthetic oligonucleotide
cagtggcccaggcttggaaa

SEQ ID NO: 490 - DNA, 20 bp, Artificial sequence
  Synthetic oligonucleotide
tgcctcccagacccccacac

SEQ ID NO: 491 - DNA, 20 bp, Artificial sequence
  Synthetic oligonucleotide
agtggccgtgggaaggacag

SEQ ID NO: 492 - DNA, 20 bp, Artificial sequence
  Synthetic oligonucleotide
acaacagcacagcggcgcag

SEQ ID NO: 493 - DNA, 20 bp, Artificial sequence
  Synthetic oligonucleotide
acggcagacaacagcacagc

SEQ ID NO: 494 - DNA, 20 bp, Artificial sequence
  Synthetic oligonucleotide
gaattcgggacattgtgacg

SEQ ID NO: 495 - DNA, 20 bp, Artificial sequence
  Synthetic oligonucleotide
cagggtcattactgagaagg

SEQ ID NO: 496 - DNA, 20 bp, Artificial sequence
  Synthetic oligonucleotide
ctcagtatggagtaggtacc

SEQ ID NO: 497 - DNA, 20 bp, Artificial sequence
  Synthetic oligonucleotide
tgtgcctggactttgccttc

SEQ ID NO: 498 - DNA, 20 bp, Artificial sequence
  Synthetic oligonucleotide
ggaactgagagtgagaggct

SEQ ID NO: 499 - DNA, 20 bp, Artificial sequence
  Synthetic oligonucleotide
gaatcagatcatgagattcg

SEQ ID NO: 500 - DNA, 20 bp, Artificial sequence
  Synthetic oligonucleotide
cacatctgtgacgggaggag

SEQ ID NO: 501 - DNA, 20 bp, Artificial sequence
  Synthetic oligonucleotide
cacctagggtcacagctgag

SEQ ID NO: 502 - DNA, 20 bp, Artificial sequence
  Synthetic oligonucleotide
gaaagggctctctccatgtc

SEQ ID NO: 503 - DNA, 20 bp, Artificial sequence
  Synthetic oligonucleotide
gtgggctcagcacaggaagg

SEQ ID NO: 504 - DNA, 20 bp, Artificial sequence
  Synthetic oligonucleotide
acccagcctgctgctgtggg

SEQ ID NO: 505 - DNA, 20 bp, Artificial sequence
  Synthetic oligonucleotide
accactgacaaccaagacac

SEQ ID NO: 506 - DNA, 20 bp, Artificial sequence
  Synthetic oligonucleotide
gccctgggtgccttgccctt

SEQ ID NO: 507 - DNA, 20 bp, Artificial sequence
  Synthetic oligonucleotide
acaagctagggtgcaagtgg

SEQ ID NO: 508 - DNA, 20 bp, Artificial sequence
  Synthetic oligonucleotide
ggagctgagcagcgggctgg

SEQ ID NO: 509 - DNA, 20 bp, Artificial sequence
  Synthetic oligonucleotide
ccctttgtcgggtgtggagg

SEQ ID NO: 510 - DNA, 20 bp, Artificial sequence
  Synthetic oligonucleotide
tggcttccagctgggactgg

SEQ ID NO: 511 - DNA, 20 bp, Artificial sequence
  Synthetic oligonucleotide
atatgttcagctgctccagc

SEQ ID NO: 512 - DNA, 20 bp, Artificial sequence
  Synthetic oligonucleotide
actcaacagggtgcagatgg

SEQ ID NO: 513 - DNA, 20 bp, Artificial sequence
  Synthetic oligonucleotide
gaatccaagcataaacagac

SEQ ID NO: 514 - DNA, 20 bp, Artificial sequence
  Synthetic oligonucleotide
tttttttcttttcactatca

SEQ ID NO: 515 - DNA, 20 bp, Artificial sequence
  Synthetic oligonucleotide
agcatttcaagatacatgcg

SEQ ID NO: 516 - DNA, 20 bp, Artificial sequence
  Synthetic oligonucleotide
cacacgagtcccagtgtggg

SEQ ID NO: 517 - DNA, 20 bp, Artificial sequence
  Synthetic oligonucleotide
ttgggtcccaggtgctgagg

SEQ ID NO: 518 - DNA, 20 bp, Artificial sequence
  Synthetic oligonucleotide
acggcctccttagctgctag

SEQ ID NO: 519 - DNA, 20 bp, Artificial sequence
  Synthetic oligonucleotide
taatcctgtgcttcaggcct

SEQ ID NO: 520 - DNA, 20 bp, Artificial sequence
  Synthetic oligonucleotide
tgacacagggagccccaagg

SEQ ID NO: 521 - DNA, 20 bp, Artificial sequence
  Synthetic oligonucleotide
agccagaccagccacaagac

SEQ ID NO: 522 - DNA, 20 bp, Artificial sequence
  Synthetic oligonucleotide
gctatgaccagagagaacca

SEQ ID NO: 523 - DNA, 20 bp, Artificial sequence
  Synthetic oligonucleotide
ggactgccatgagacttcgg

SEQ ID NO: 524 - DNA, 20 bp, Artificial sequence
  Synthetic oligonucleotide
taagcctcctttgggactgc

SEQ ID NO: 525 - DNA, 20 bp, Artificial sequence
  Synthetic oligonucleotide
agtggcttcctttttcttgt

SEQ ID NO: 526 - DNA, 20 bp, Artificial sequence
  Synthetic oligonucleotide
ggcaatgcctggaagaaact

SEQ ID NO: 527 - DNA, 20 bp, Artificial sequence
  Synthetic oligonucleotide
cgctggtgagagtgtgactg

SEQ ID NO: 528 - DNA, 20 bp, Artificial sequence
  Synthetic oligonucleotide
atccgagggtgagatgataa

SEQ ID NO: 529 - DNA, 20 bp, Artificial sequence
  Synthetic oligonucleotide
aataatttctccaggctcat

SEQ ID NO: 530 - DNA, 20 bp, Artificial sequence
  Synthetic oligonucleotide
gctgacttcgatttgttatt

SEQ ID NO: 531 - DNA, 20 bp, Artificial sequence
  Synthetic oligonucleotide
tatcatatggcacaaattct

SEQ ID NO: 532 - DNA, 20 bp, Artificial sequence
  Synthetic oligonucleotide
ctacctgggaccacacctta

SEQ ID NO: 533 - DNA, 20 bp, Artificial sequence
  Synthetic oligonucleotide
gggtggagagcctgatggtc

SEQ ID NO: 534 - DNA, 20 bp, Artificial sequence
  Synthetic oligonucleotide
ctgtgagcatcatgaaagcc

SEQ ID NO: 535 - DNA, 20 bp, Artificial sequence
  Synthetic oligonucleotide
ttttattatgagggagatca

SEQ ID NO: 536 - DNA, 20 bp, Artificial sequence
  Synthetic oligonucleotide
aatagtagagaaatggaaat

SEQ ID NO: 537 - DNA, 20 bp, Artificial sequence
  Synthetic oligonucleotide
taacatgacagggttaggcc

SEQ ID NO: 538 - DNA, 20 bp, Artificial sequence
  Synthetic oligonucleotide
gcccacacacatgctcatgc

SEQ ID NO: 539 - DNA, 20 bp, Artificial sequence
  Synthetic oligonucleotide
tgtgttcagttacatgcctt

SEQ ID NO: 540 - DNA, 20 bp, Artificial sequence
  Synthetic oligonucleotide
gaccaccatggtgggctgac

SEQ ID NO: 541 - DNA, 20 bp, Artificial sequence
  Synthetic oligonucleotide
ggcacctctctgcagacttt

SEQ ID NO: 542 - DNA, 20 bp, Artificial sequence
  Synthetic oligonucleotide
tgcttcacacaccacaatgg

SEQ ID NO: 543 - DNA, 20 bp, Artificial sequence
  Synthetic oligonucleotide
aacattgccgagcaccagcc

SEQ ID NO: 544 - DNA, 20 bp, Artificial sequence
  Synthetic oligonucleotide
gactcaggaacatgttagct

SEQ ID NO: 545 - DNA, 20 bp, Artificial sequence
  Synthetic oligonucleotide
cacggctcagcagaggagac

SEQ ID NO: 546 - DNA, 20 bp, Artificial sequence
  Synthetic oligonucleotide
gctgctatccttcctgggcc

SEQ ID NO: 547 - DNA, 20 bp, Artificial sequence
  Synthetic oligonucleotide
ggaaatgaaagcttcccacg

SEQ ID NO: 548 - DNA, 20 bp, Artificial sequence
  Synthetic oligonucleotide
aacagtcagaatacccccaa

SEQ ID NO: 549 - DNA, 20 bp, Artificial sequence
  Synthetic oligonucleotide
tataggtagaatataaaact

SEQ ID NO: 550 - DNA, 20 bp, Artificial sequence
  Synthetic oligonucleotide
tatgaacaaaactgcaggac

SEQ ID NO: 551 - DNA, 20 bp, Artificial sequence
  Synthetic oligonucleotide
agcctccagagtgacaggtg

SEQ ID NO: 552 - DNA, 20 bp, Artificial sequence
  Synthetic oligonucleotide
ccataagccactcctggttg

SEQ ID NO: 553 - DNA, 20 bp, Artificial sequence
  Synthetic oligonucleotide
cagcttggaagatacaggag

SEQ ID NO: 554 - DNA, 20 bp, Artificial sequence
  Synthetic oligonucleotide
caaacttaagaaaagttgca

SEQ ID NO: 555 - DNA, 20 bp, Artificial sequence
  Synthetic oligonucleotide
tgctggcaaagaagacagga

SEQ ID NO: 556 - DNA, 20 bp, Artificial sequence
  Synthetic oligonucleotide
ccactgatggccgggtgcag

SEQ ID NO: 557 - DNA, 20 bp, Artificial sequence
  Synthetic oligonucleotide
tgggtgtcaaatggctggct

SEQ ID NO: 558 - DNA, 20 bp, Artificial sequence
  Synthetic oligonucleotide
tagaaagctatttaataaat

SEQ ID NO: 559 - DNA, 20 bp, Artificial sequence
  Synthetic oligonucleotide
agccgtacatcaatggtaca

SEQ ID NO: 560 - DNA, 20 bp, Artificial sequence
  Synthetic oligonucleotide
ggccctaccatggtcgattt

SEQ ID NO: 561 - DNA, 20 bp, Artificial sequence
  Synthetic oligonucleotide
atcagtgccagagacagagg

SEQ ID NO: 562 - DNA, 20 bp, Artificial sequence
  Synthetic oligonucleotide
tattattaacgaacaaaaaa

SEQ ID NO: 563 - DNA, 20 bp, Artificial sequence
  Synthetic oligonucleotide
agagcaatactttgtgctta

SEQ ID NO: 564 - DNA, 20 bp, Artificial sequence
  Synthetic oligonucleotide
agactcctcaaatgtgcgcc

SEQ ID NO: 565 - DNA, 20 bp, Artificial sequence
  Synthetic oligonucleotide
gaatgacggccgcctcctct

SEQ ID NO: 566 - DNA, 20 bp, Artificial sequence
  Synthetic oligonucleotide
tatggagggcttctggcctc

SEQ ID NO: 567 - DNA, 20 bp, Artificial sequence
  Synthetic oligonucleotide
gagaaagagcgagtaattag

SEQ ID NO: 568 - DNA, 20 bp, Artificial sequence
  Synthetic oligonucleotide
tagctagaaactgtgtccct

SEQ ID NO: 569 - DNA, 20 bp, Artificial sequence
  Synthetic oligonucleotide
ctgtgagatcatcccctggt

SEQ ID NO: 570 - DNA, 20 bp, Artificial sequence
  Synthetic oligonucleotide
cagcgcagtgcagggagtca

SEQ ID NO: 571 - DNA, 20 bp, Artificial sequence
  Synthetic oligonucleotide
gggtacacagagaggccact

SEQ ID NO: 572 - DNA, 20 bp, Artificial sequence
  Synthetic oligonucleotide
gaacgatgcactgccttggc

SEQ ID NO: 573 - DNA, 20 bp, Artificial sequence
  Synthetic oligonucleotide
caccatattacaccagttgt

SEQ ID NO: 574 - DNA, 20 bp, Artificial sequence
  Synthetic oligonucleotide
ctgaaatgaatcccctgaac

SEQ ID NO: 575 - DNA, 20 bp, Artificial sequence
  Synthetic oligonucleotide
gtgtccacgaatgcccctgg

SEQ ID NO: 576 - DNA, 20 bp, Artificial sequence
  Synthetic oligonucleotide
acggatggttgctgctgatg

SEQ ID NO: 577 - DNA, 20 bp, Artificial sequence
  Synthetic oligonucleotide
gtcccttttgctcccaaaga

SEQ ID NO: 578 - DNA, 20 bp, Artificial sequence
  Synthetic oligonucleotide
cagtcttttaataagtgaaa

SEQ ID NO: 579 - DNA, 20 bp, Artificial sequence
  Synthetic oligonucleotide
ttagctaaattgaggcccgg

SEQ ID NO: 580 - DNA, 20 bp, Artificial sequence
  Synthetic oligonucleotide
ggaaaggtattgcctcctga

SEQ ID NO: 581 - DNA, 20 bp, Artificial sequence
  Synthetic oligonucleotide
ggtgactacgcagcctggac

SEQ ID NO: 582 - DNA, 20 bp, Artificial sequence
  Synthetic oligonucleotide
ttcagggcaatccttgaggt

SEQ ID NO: 583 - DNA, 20 bp, Artificial sequence
  Synthetic oligonucleotide
tgctaatgctttgggaccta

SEQ ID NO: 584 - DNA, 20 bp, Artificial sequence
  Synthetic oligonucleotide
tgggtagagagcaactgttc

SEQ ID NO: 585 - DNA, 20 bp, Artificial sequence
  Synthetic oligonucleotide
acaccccttctctgcacatc

SEQ ID NO: 586 - DNA, 20 bp, Artificial sequence
  Synthetic oligonucleotide
ctgctagagttcgccaacag

SEQ ID NO: 587 - DNA, 20 bp, Artificial sequence
  Synthetic oligonucleotide
tcttattctctaggtgggct

SEQ ID NO: 588 - DNA, 20 bp, Artificial sequence
  Synthetic oligonucleotide
cagtgcaagtgggtatgaag

SEQ ID NO: 589 - DNA, 20 bp, Artificial sequence
  Synthetic oligonucleotide
cagatgcagtgcaagtgggt

SEQ ID NO: 590 - DNA, 20 bp, Artificial sequence
  Synthetic oligonucleotide
gaaaaactttgtccataatt

SEQ ID NO: 591 - DNA, 20 bp, Artificial sequence
  Synthetic oligonucleotide
taatgaatgtataacagaaa

SEQ ID NO: 592 - DNA, 20 bp, Artificial sequence
  Synthetic oligonucleotide
aaaaggcagatactttgtgg

SEQ ID NO: 593 - DNA, 20 bp, Artificial sequence
  Synthetic oligonucleotide
cagaggtgtgaaagtaaaag

SEQ ID NO: 594 - DNA, 20 bp, Artificial sequence
  Synthetic oligonucleotide
cagctaaagctttgtgaaca

SEQ ID NO: 595 - DNA, 20 bp, Artificial sequence
  Synthetic oligonucleotide
tgcagcccaggtgagccagc

SEQ ID NO: 596 - DNA, 20 bp, Artificial sequence
  Synthetic oligonucleotide
gcctctcctcccagttcatg

SEQ ID NO: 597 - DNA, 20 bp, Artificial sequence
  Synthetic oligonucleotide
gttttcttatttttagcatt

SEQ ID NO: 598 - DNA, 20 bp, Artificial sequence
  Synthetic oligonucleotide
ggagggacgagaaacagcag

SEQ ID NO: 599 - DNA, 20 bp, Artificial sequence
  Synthetic oligonucleotide
agcttccagcatgaacatag

SEQ ID NO: 600 - DNA, 20 bp, Artificial sequence
  Synthetic oligonucleotide
gagccctgatatgatagagg

SEQ ID NO: 601 - DNA, 20 bp, Artificial sequence
  Synthetic oligonucleotide
tgtaccatgcctggcagatg

SEQ ID NO: 602 - DNA, 20 bp, Artificial sequence
  Synthetic oligonucleotide
gttagatgtatgtatgatgg

SEQ ID NO: 603 - DNA, 20 bp, Artificial sequence
  Synthetic oligonucleotide
gcctcctcctagagctcctg

SEQ ID NO: 604 - DNA, 20 bp, Artificial sequence
  Synthetic oligonucleotide
cggcctcgcaacaaacccac

SEQ ID NO: 605 - DNA, 20 bp, Artificial sequence
  Synthetic oligonucleotide
tccactgacctgccccttcc

SEQ ID NO: 606 - DNA, 20 bp, Artificial sequence
  Synthetic oligonucleotide
tttgcaacttgttcctgctt

SEQ ID NO: 607 - DNA, 20 bp, Artificial sequence
  Synthetic oligonucleotide
tcttgggtgcaggcggagca

SEQ ID NO: 608 - DNA, 20 bp, Artificial sequence
  Synthetic oligonucleotide
acccaagattcccaggagcc

SEQ ID NO: 609 - DNA, 20 bp, Artificial sequence
  Synthetic oligonucleotide
aggccctaaatgctctgaga

SEQ ID NO: 610 - DNA, 20 bp, Artificial sequence
  Synthetic oligonucleotide
agaagtctctggaactgacg

SEQ ID NO: 611 - DNA, 20 bp, Artificial sequence
  Synthetic oligonucleotide
tcaccaaaccaatggctggc

SEQ ID NO: 612 - DNA, 20 bp, Artificial sequence
  Synthetic oligonucleotide
ggtgaaatcctggctaggcc

SEQ ID NO: 613 - DNA, 20 bp, Artificial sequence
  Synthetic oligonucleotide
tgcagattcggcctgagttt

SEQ ID NO: 614 - DNA, 20 bp, Artificial sequence
  Synthetic oligonucleotide
ccaaacaagaaagactgaga

SEQ ID NO: 615 - DNA, 20 bp, Artificial sequence
  Synthetic oligonucleotide
ccatgtccctccccccaacc

SEQ ID NO: 616 - DNA, 20 bp, Artificial sequence
  Synthetic oligonucleotide
attagaaaaaaaccactagg

SEQ ID NO: 617 - DNA, 20 bp, Artificial sequence
  Synthetic oligonucleotide
agcttactagagtgctcttg

SEQ ID NO: 618 - DNA, 20 bp, Artificial sequence
  Synthetic oligonucleotide
atttttttctggttcattca

SEQ ID NO: 619 - DNA, 20 bp, Artificial sequence
  Synthetic oligonucleotide
cgcttaagagagggagcatc

SEQ ID NO: 620 - DNA, 20 bp, Artificial sequence
  Synthetic oligonucleotide
gtggagatacgcagtggtgg

SEQ ID NO: 621 - DNA, 20 bp, Artificial sequence
  Synthetic oligonucleotide
cccaaacctggctctgtcac

SEQ ID NO: 622 - DNA, 20 bp, Artificial sequence
  Synthetic oligonucleotide
atcaaccagcaccatccacg

SEQ ID NO: 623 - DNA, 20 bp, Artificial sequence
  Synthetic oligonucleotide
gggtctgtaagcctaaagtg

SEQ ID NO: 624 - DNA, 20 bp, Artificial sequence
  Synthetic oligonucleotide
tgggtctgtaagcctaaagt

SEQ ID NO: 625 - DNA, 20 bp, Artificial sequence
  Synthetic oligonucleotide
tatactatgtggcagaatca

SEQ ID NO: 626 - DNA, 20 bp, Artificial sequence
  Synthetic oligonucleotide
cacattccctctaccccatg

SEQ ID NO: 627 - DNA, 20 bp, Artificial sequence
  Synthetic oligonucleotide
tcatagattttcttctttgg

SEQ ID NO: 628 - DNA, 20 bp, Artificial sequence
  Synthetic oligonucleotide
ttcaaacacaccttcattta

SEQ ID NO: 629 - DNA, 20 bp, Artificial sequence
  Synthetic oligonucleotide
ccccagctggccgaggccca

SEQ ID NO: 630 - DNA, 20 bp, Artificial sequence
  Synthetic oligonucleotide
gagaagggtcctgtcccaga

SEQ ID NO: 631 - DNA, 20 bp, Artificial sequence
  Synthetic oligonucleotide
agtaagttgatggagatcat

SEQ ID NO: 632 - DNA, 20 bp, Artificial sequence
  Synthetic oligonucleotide
caccagccccactccgccac

SEQ ID NO: 633 - DNA, 20 bp, Artificial sequence
  Synthetic oligonucleotide
tgctctgtctccagagacat

SEQ ID NO: 634 - DNA, 20 bp, Artificial sequence
  Synthetic oligonucleotide
atccaagatccaggccaggc

SEQ ID NO: 635 - DNA, 20 bp, Artificial sequence
  Synthetic oligonucleotide
agagacccagggtgaccagt

SEQ ID NO: 636 - DNA, 20 bp, Artificial sequence
  Synthetic oligonucleotide
caaatttctcgatccccttc

SEQ ID NO: 637 - DNA, 20 bp, Artificial sequence
  Synthetic oligonucleotide
cctgaggagggcactcacag

SEQ ID NO: 638 - DNA, 20 bp, Artificial sequence
  Synthetic oligonucleotide
gtggctacccacggccacag

SEQ ID NO: 639 - DNA, 20 bp, Artificial sequence
  Synthetic oligonucleotide
ctaccaggagcacacacaga

SEQ ID NO: 640 - DNA, 20 bp, Artificial sequence
  Synthetic oligonucleotide
ccctaagccatggtgggttt

SEQ ID NO: 641 - DNA, 20 bp, Artificial sequence
  Synthetic oligonucleotide
cccttgtccccacagccaca

SEQ ID NO: 642 - DNA, 20 bp, Artificial sequence
  Synthetic oligonucleotide
gggtcacctgtgagttattt

SEQ ID NO: 643 - DNA, 20 bp, Artificial sequence
  Synthetic oligonucleotide
agctgcctccagttgtttat

SEQ ID NO: 644 - DNA, 20 bp, Artificial sequence
  Synthetic oligonucleotide
actttagctccatcttctca

SEQ ID NO: 645 - DNA, 20 bp, Artificial sequence
  Synthetic oligonucleotide
ctataatggtcagtggtgta

SEQ ID NO: 646 - DNA, 20 bp, Artificial sequence
  Synthetic oligonucleotide
tgaaggagaggctgtggtga

SEQ ID NO: 647 - DNA, 20 bp, Artificial sequence
  Synthetic oligonucleotide
tgtgacaacaaagttgtcct

SEQ ID NO: 648 - DNA, 20 bp, Artificial sequence
  Synthetic oligonucleotide
ccctgcaatcaacacaggag

SEQ ID NO: 649 - DNA, 20 bp, Artificial sequence
  Synthetic oligonucleotide
tctaacatgcacatatttac

SEQ ID NO: 650 - DNA, 20 bp, Artificial sequence
  Synthetic oligonucleotide
agcactgggtgtttacaaca

SEQ ID NO: 651 - DNA, 20 bp, Artificial sequence
  Synthetic oligonucleotide
acccggtgacctttcctctc

SEQ ID NO: 652 - DNA, 20 bp, Artificial sequence
  Synthetic oligonucleotide
gccacagcacggcgcatggg

SEQ ID NO: 653 - DNA, 20 bp, Artificial sequence
  Synthetic oligonucleotide
gcaccgctccctctgggaat

SEQ ID NO: 654 - DNA, 20 bp, Artificial sequence
  Synthetic oligonucleotide
aaatcttgctggaaaggcag

SEQ ID NO: 655 - DNA, 20 bp, Artificial sequence
  Synthetic oligonucleotide
gacccagacatttgctcagc

SEQ ID NO: 656 - DNA, 20 bp, Artificial sequence
  Synthetic oligonucleotide
gggctcccgcaagtttcaca

SEQ ID NO: 657 - DNA, 20 bp, Artificial sequence
  Synthetic oligonucleotide
gagaggccctgtggacagct

SEQ ID NO: 658 - DNA, 20 bp, Artificial sequence
  Synthetic oligonucleotide
cccactggatgctgctgagg

SEQ ID NO: 659 - DNA, 20 bp, Artificial sequence
  Synthetic oligonucleotide
gtgcctagtaacccatttag

SEQ ID NO: 660 - DNA, 20 bp, Artificial sequence
  Synthetic oligonucleotide
cacccacagcaagacctaga

SEQ ID NO: 661 - DNA, 20 bp, Artificial sequence
  Synthetic oligonucleotide
acacagagaagcttccagag

SEQ ID NO: 662 - DNA, 20 bp, Artificial sequence
  Synthetic oligonucleotide
agctatcacatggacgagtt

SEQ ID NO: 663 - DNA, 20 bp, Artificial sequence
  Synthetic oligonucleotide
catttaatacaggctttgat

SEQ ID NO: 664 - DNA, 20 bp, Artificial sequence
  Synthetic oligonucleotide
agccactgatgcccagacat

SEQ ID NO: 665 - DNA, 18 bp, Artificial sequence
  Synthetic oligonucleotide
gttttcaaacacaccttc

SEQ ID NO: 666 - DNA, 18 bp, Artificial sequence
  Synthetic oligonucleotide
tcgccaacagacatgtga

SEQ ID NO: 667 - DNA, 18 bp, Artificial sequence
  Synthetic oligonucleotide
tgaaggagcctgggaagt

SEQ ID NO: 668 - DNA, 18 bp, Artificial sequence
  Synthetic oligonucleotide
agcagagatgtggctggg

SEQ ID NO: 669 - DNA, 18 bp, Artificial sequence
  Synthetic oligonucleotide
gtgaggttgaaaagtttc

SEQ ID NO: 670 - DNA, 18 bp, Artificial sequence
  Synthetic oligonucleotide
tggtttctgatggttttt

SEQ ID NO: 671 - DNA, 18 bp, Artificial sequence
  Synthetic oligonucleotide
gttggaactcctgggatc

SEQ ID NO: 672 - DNA, 18 bp, Artificial sequence
  Synthetic oligonucleotide
tcagcatttttctcctct

SEQ ID NO: 673 - DNA, 18 bp, Artificial sequence
  Synthetic oligonucleotide
ctggaatggtacgatctc

SEQ ID NO: 674 - DNA, 18 bp, Artificial sequence
  Synthetic oligonucleotide
ccactctggtgcaggacg

SEQ ID NO: 675 - DNA, 18 bp, Artificial sequence
  Synthetic oligonucleotide
cagatgcagtgcaagtgg

SEQ ID NO: 676 - DNA, 18 bp, Artificial sequence
  Synthetic oligonucleotide
gggtttcaccagacctca

SEQ ID NO: 677 - DNA, 18 bp, Artificial sequence
  Synthetic oligonucleotide
ctttgtccataatttttt

SEQ ID NO: 678 - DNA, 18 bp, Artificial sequence
  Synthetic oligonucleotide
tatagcatgagcatttgt

SEQ ID NO: 679 - DNA, 18 bp, Artificial sequence
  Synthetic oligonucleotide
taatgaatgtataacaga

SEQ ID NO: 680 - DNA, 18 bp, Artificial sequence
  Synthetic oligonucleotide
tcctcctggctgccctgt

SEQ ID NO: 681 - DNA, 18 bp, Artificial sequence
  Synthetic oligonucleotide
catcctgccataccagac

SEQ ID NO: 682 - DNA, 18 bp, Artificial sequence
  Synthetic oligonucleotide
tatccgcctctcaaagtg

SEQ ID NO: 683 - DNA, 18 bp, Artificial sequence
  Synthetic oligonucleotide
cacatttgcatattttca

SEQ ID NO: 684 - DNA, 18 bp, Artificial sequence
  Synthetic oligonucleotide
tcgggttgccccattcaa

SEQ ID NO: 685 - DNA, 18 bp, Artificial sequence
  Synthetic oligonucleotide
aaccaccatttactcaca

SEQ ID NO: 686 - DNA, 18 bp, Artificial sequence
  Synthetic oligonucleotide
accggcacccaccaggtc

SEQ ID NO: 687 - DNA, 18 bp, Artificial sequence
  Synthetic oligonucleotide
agggacagcatcagcaga

SEQ ID NO: 688 - DNA, 18 bp, Artificial sequence
  Synthetic oligonucleotide
aggcatgtggcaggtgcc

SEQ ID NO: 689 - DNA, 18 bp, Artificial sequence
  Synthetic oligonucleotide
accaacaccgcagcagtt

SEQ ID NO: 690 - DNA, 18 bp, Artificial sequence
  Synthetic oligonucleotide
gttctgaggagtgttggg

SEQ ID NO: 691 - DNA, 18 bp, Artificial sequence
  Synthetic oligonucleotide
actaacctttcaggccag

SEQ ID NO: 692 - DNA, 18 bp, Artificial sequence
  Synthetic oligonucleotide
taaattattttagagacg

SEQ ID NO: 693 - DNA, 18 bp, Artificial sequence
  Synthetic oligonucleotide
caaggtaaatttctttct

SEQ ID NO: 694 - DNA, 18 bp, Artificial sequence
  Synthetic oligonucleotide
tcaggcctgatctaagta

SEQ ID NO: 695 - DNA, 18 bp, Artificial sequence
  Synthetic oligonucleotide
tccccaaccatgtggtct

SEQ ID NO: 696 - DNA, 18 bp, Artificial sequence
  Synthetic oligonucleotide
tgccagccacacccatgg

SEQ ID NO: 697 - DNA, 18 bp, Artificial sequence
  Synthetic oligonucleotide
aactccacggcttccatg

SEQ ID NO: 698 - DNA, 18 bp, Artificial sequence
  Synthetic oligonucleotide
agatagaaatctgaaacg

SEQ ID NO: 699 - DNA, 18 bp, Artificial sequence
  Synthetic oligonucleotide
gctgggccgagctgcatt

SEQ ID NO: 700 - DNA, 18 bp, Artificial sequence
  Synthetic oligonucleotide
ggattcaaaggagaaaac

SEQ ID NO: 701 - DNA, 18 bp, Artificial sequence
  Synthetic oligonucleotide
attattatttgacatggg

SEQ ID NO: 702 - DNA, 18 bp, Artificial sequence
  Synthetic oligonucleotide
agggtaggcagtgttgtg

SEQ ID NO: 703 - DNA, 18 bp, Artificial sequence
  Synthetic oligonucleotide
ctctctttgtcaggaaaa

SEQ ID NO: 704 - DNA, 18 bp, Artificial sequence
  Synthetic oligonucleotide
cctttttttttaggacgg

SEQ ID NO: 705 - DNA, 18 bp, Artificial sequence
  Synthetic oligonucleotide
gagttgactgggcacggt

SEQ ID NO: 706 - DNA, 18 bp, Artificial sequence
  Synthetic oligonucleotide
tcatctgtgaagcggacg

SEQ ID NO: 707 - DNA, 18 bp, Artificial sequence
  Synthetic oligonucleotide
ggcacaatccatatgagg

SEQ ID NO: 708 - DNA, 18 bp, Artificial sequence
  Synthetic oligonucleotide
gttattttggaacagttt

SEQ ID NO: 709 - DNA, 18 bp, Artificial sequence
  Synthetic oligonucleotide
ctggactttatttcattt

SEQ ID NO: 710 - DNA, 18 bp, Artificial sequence
  Synthetic oligonucleotide
cagtatatatagtgcata

SEQ ID NO: 711 - DNA, 18 bp, Artificial sequence
  Synthetic oligonucleotide
caaaacagctccttgtaa

SEQ ID NO: 712 - DNA, 18 bp, Artificial sequence
  Synthetic oligonucleotide
actttcatctacttttca

SEQ ID NO: 713 - DNA, 18 bp, Artificial sequence
  Synthetic oligonucleotide
ccaatctgtccccagctt

SEQ ID NO: 714 - DNA, 18 bp, Artificial sequence
  Synthetic oligonucleotide
tccagcatgaacatagct

SEQ ID NO: 715 - DNA, 18 bp, Artificial sequence
  Synthetic oligonucleotide
tagagtcagtttcaggat

SEQ ID NO: 716 - DNA, 18 bp, Artificial sequence
  Synthetic oligonucleotide
ggtggtatcaccaacagc

SEQ ID NO: 717 - DNA, 18 bp, Artificial sequence
  Synthetic oligonucleotide
ttaaggaatggctctggg

SEQ ID NO: 718 - DNA, 18 bp, Artificial sequence
  Synthetic oligonucleotide
gaacatgagacatcttga

SEQ ID NO: 719 - DNA, 18 bp, Artificial sequence
  Synthetic oligonucleotide
agctgtgcccagttaaaa

SEQ ID NO: 720 - DNA, 18 bp, Artificial sequence
  Synthetic oligonucleotide
tctggtcatatgaggaaa

SEQ ID NO: 721 - DNA, 18 bp, Artificial sequence
  Synthetic oligonucleotide
agtcattatcatgtcacc

SEQ ID NO: 722 - DNA, 18 bp, Artificial sequence
  Synthetic oligonucleotide
gctgagcgaattacctaa

SEQ ID NO: 723 - DNA, 18 bp, Artificial sequence
  Synthetic oligonucleotide
cctctgtatgacagaaat

SEQ ID NO: 724 - DNA, 18 bp, Artificial sequence
  Synthetic oligonucleotide
ggtaacatgtaaagcttc

SEQ ID NO: 725 - DNA, 18 bp, Artificial sequence
  Synthetic oligonucleotide
tggattatgtacagatat

SEQ ID NO: 726 - DNA, 18 bp, Artificial sequence
  Synthetic oligonucleotide
atggatgataggaaggat

SEQ ID NO: 727 - DNA, 18 bp, Artificial sequence
  Synthetic oligonucleotide
gatggaggaaggaatgat

SEQ ID NO: 728 - DNA, 18 bp, Artificial sequence
  Synthetic oligonucleotide
ctggatggttacatggat

SEQ ID NO: 729 - DNA, 18 bp, Artificial sequence
  Synthetic oligonucleotide
ataattgatgtataatta

SEQ ID NO: 730 - DNA, 18 bp, Artificial sequence
  Synthetic oligonucleotide
gttctgccccacctgggc

SEQ ID NO: 731 - DNA, 18 bp, Artificial sequence
  Synthetic oligonucleotide
gcctctcagggcctccgt

SEQ ID NO: 732 - DNA, 18 bp, Artificial sequence
  Synthetic oligonucleotide
gaaggatggccacacaga

SEQ ID NO: 733 - DNA, 18 bp, Artificial sequence
  Synthetic oligonucleotide
atgggcttatcaatgcat

SEQ ID NO: 734 - DNA, 18 bp, Artificial sequence
  Synthetic oligonucleotide
gaggcccaaatgatcaca

SEQ ID NO: 735 - DNA, 18 bp, Artificial sequence
  Synthetic oligonucleotide
gctcagggcagacacggt

SEQ ID NO: 736 - DNA, 18 bp, Artificial sequence
  Synthetic oligonucleotide
cttaaccagctagtggtg

SEQ ID NO: 737 - DNA, 18 bp, Artificial sequence
  Synthetic oligonucleotide
gtcctgtggagctgaaaa

SEQ ID NO: 738 - DNA, 18 bp, Artificial sequence
  Synthetic oligonucleotide
ggctggaggcatggaggg

SEQ ID NO: 739 - DNA, 18 bp, Artificial sequence
  Synthetic oligonucleotide
tgcctccagagcacacac

SEQ ID NO: 740 - DNA, 18 bp, Artificial sequence
  Synthetic oligonucleotide
aggatactaaaccaagat

SEQ ID NO: 741 - DNA, 18 bp, Artificial sequence
  Synthetic oligonucleotide
cacagatgggaagcaaga

SEQ ID NO: 742 - DNA, 18 bp, Artificial sequence
  Synthetic oligonucleotide
catgaggcaacaatccaa

SEQ ID NO: 743 - DNA, 18 bp, Artificial sequence
  Synthetic oligonucleotide
gccgtaagacccagctct

SEQ ID NO: 744 - DNA, 18 bp, Artificial sequence
  Synthetic oligonucleotide
gaagaagtactgagaaag

SEQ ID NO: 745 - DNA, 18 bp, Artificial sequence
  Synthetic oligonucleotide
taagaacctcagcggcaa

SEQ ID NO: 746 - DNA, 18 bp, Artificial sequence
  Synthetic oligonucleotide
tgagggagcactgagagt

SEQ ID NO: 747 - DNA, 18 bp, Artificial sequence
  Synthetic oligonucleotide
agttcaatgaaggacatt

SEQ ID NO: 748 - DNA, 18 bp, Artificial sequence
  Synthetic oligonucleotide
actgttggatgggtccac

SEQ ID NO: 749 - DNA, 18 bp, Artificial sequence
  Synthetic oligonucleotide
ttggtccattttgattgg

SEQ ID NO: 750 - DNA, 18 bp, Artificial sequence
  Synthetic oligonucleotide
cggcagccctgtgtaaac

SEQ ID NO: 751 - DNA, 18 bp, Artificial sequence
  Synthetic oligonucleotide
cctttgcttcttgcgcag

SEQ ID NO: 752 - DNA, 18 bp, Artificial sequence
  Synthetic oligonucleotide
agggccttgactgcctgg

SEQ ID NO: 753 - DNA, 18 bp, Artificial sequence
  Synthetic oligonucleotide
aaggccctaaatgctctg

SEQ ID NO: 754 - DNA, 18 bp, Artificial sequence
  Synthetic oligonucleotide
cgctcaggtgatcttggg

SEQ ID NO: 755 - DNA, 18 bp, Artificial sequence
  Synthetic oligonucleotide
ctgattgattccccatca

SEQ ID NO: 756 - DNA, 18 bp, Artificial sequence
  Synthetic oligonucleotide
ttcttgttgggcaactgg

SEQ ID NO: 757 - DNA, 18 bp, Artificial sequence
  Synthetic oligonucleotide
gaaatgcactcagaaggg

SEQ ID NO: 758 - DNA, 18 bp, Artificial sequence
  Synthetic oligonucleotide
cctcagtgaaataactgt

SEQ ID NO: 759 - DNA, 18 bp, Artificial sequence
  Synthetic oligonucleotide
tggctgcaactttgaatg

SEQ ID NO: 760 - DNA, 18 bp, Artificial sequence
  Synthetic oligonucleotide
ctggagatggcaggctgg

SEQ ID NO: 761 - DNA, 18 bp, Artificial sequence
  Synthetic oligonucleotide
cccgtgggccccatgtgg

SEQ ID NO: 762 - DNA, 18 bp, Artificial sequence
  Synthetic oligonucleotide
attgaggacacctggtgt

SEQ ID NO: 763 - DNA, 18 bp, Artificial sequence
  Synthetic oligonucleotide
aaggtctgcattgtcagt

SEQ ID NO: 764 - DNA, 18 bp, Artificial sequence
  Synthetic oligonucleotide
ctgctggcctctctgtac

SEQ ID NO: 765 - DNA, 18 bp, Artificial sequence
  Synthetic oligonucleotide
tcggacacggtcactgcc

SEQ ID NO: 766 - DNA, 18 bp, Artificial sequence
  Synthetic oligonucleotide
gtgccttgtcatgtgaca

SEQ ID NO: 767 - DNA, 18 bp, Artificial sequence
  Synthetic oligonucleotide
ggaagccatgtggtagcc

SEQ ID NO: 768 - DNA, 18 bp, Artificial sequence
  Synthetic oligonucleotide
cagaggccactgcctctg

SEQ ID NO: 769 - DNA, 18 bp, Artificial sequence
  Synthetic oligonucleotide
ttaatagtaccaaaatca

SEQ ID NO: 770 - DNA, 18 bp, Artificial sequence
  Synthetic oligonucleotide
tacatttccttcctccca

SEQ ID NO: 771 - DNA, 18 bp, Artificial sequence
  Synthetic oligonucleotide
cggagtcaggcagatggg

SEQ ID NO: 772 - DNA, 18 bp, Artificial sequence
  Synthetic oligonucleotide
gctatgacctagtaggaa

SEQ ID NO: 773 - DNA, 18 bp, Artificial sequence
  Synthetic oligonucleotide
attgtttactagaaacca

SEQ ID NO: 774 - DNA, 18 bp, Artificial sequence
  Synthetic oligonucleotide
gggcagagcccaccccat

SEQ ID NO: 775 - DNA, 18 bp, Artificial sequence
  Synthetic oligonucleotide
aggctggacaaggctagc

SEQ ID NO: 776 - DNA, 18 bp, Artificial sequence
  Synthetic oligonucleotide
catatttgagtttctttt

SEQ ID NO: 777 - DNA, 18 bp, Artificial sequence
  Synthetic oligonucleotide
aatgattacacaaagctg

SEQ ID NO: 778 - DNA, 18 bp, Artificial sequence
  Synthetic oligonucleotide
gaacagtgtctttccagc

SEQ ID NO: 779 - DNA, 18 bp, Artificial sequence
  Synthetic oligonucleotide
atgtgcctttctgtgcca

SEQ ID NO: 780 - DNA, 18 bp, Artificial sequence
  Synthetic oligonucleotide
aatgatttctagaggtca

SEQ ID NO: 781 - DNA, 18 bp, Artificial sequence
  Synthetic oligonucleotide
ccatgattccaggctgct

SEQ ID NO: 782 - DNA, 18 bp, Artificial sequence
  Synthetic oligonucleotide
cagccaggctagtcttgc

SEQ ID NO: 783 - DNA, 18 bp, Artificial sequence
  Synthetic oligonucleotide
aggagaatgttctttttt

SEQ ID NO: 784 - DNA, 18 bp, Artificial sequence
  Synthetic oligonucleotide
ttactgtactctgatata

SEQ ID NO: 785 - DNA, 18 bp, Artificial sequence
  Synthetic oligonucleotide
ccttatgggagccctttg

SEQ ID NO: 786 - DNA, 18 bp, Artificial sequence
  Synthetic oligonucleotide
cagagcgcagcagcacct

SEQ ID NO: 787 - DNA, 18 bp, Artificial sequence
  Synthetic oligonucleotide
ctcaccagctctgcttta

SEQ ID NO: 788 - DNA, 18 bp, Artificial sequence
  Synthetic oligonucleotide
cagctgatcaagggcaca

SEQ ID NO: 789 - DNA, 18 bp, Artificial sequence
  Synthetic oligonucleotide
agacctgccataagactc

SEQ ID NO: 790 - DNA, 18 bp, Artificial sequence
  Synthetic oligonucleotide
ctgactaaaatgttattt

SEQ ID NO: 791 - DNA, 18 bp, Artificial sequence
  Synthetic oligonucleotide
acaggcatgagttttttt

SEQ ID NO: 792 - DNA, 18 bp, Artificial sequence
  Synthetic oligonucleotide
ccccttttttttggtttg

SEQ ID NO: 793 - DNA, 18 bp, Artificial sequence
  Synthetic oligonucleotide
tctggagccgccctgggc

SEQ ID NO: 794 - DNA, 18 bp, Artificial sequence
  Synthetic oligonucleotide
atgacagctctcctggtc

SEQ ID NO: 795 - DNA, 18 bp, Artificial sequence
  Synthetic oligonucleotide
actctcaactcctctggt

SEQ ID NO: 796 - DNA, 18 bp, Artificial sequence
  Synthetic oligonucleotide
tcctgttggaggaggcgc

SEQ ID NO: 797 - DNA, 18 bp, Artificial sequence
  Synthetic oligonucleotide
cctttgagttgagggacc

SEQ ID NO: 798 - DNA, 18 bp, Artificial sequence
  Synthetic oligonucleotide
gcctgagcacgggaggag

SEQ ID NO: 799 - DNA, 18 bp, Artificial sequence
  Synthetic oligonucleotide
gacaccatgagggcaccc

SEQ ID NO: 800 - DNA, 18 bp, Artificial sequence
  Synthetic oligonucleotide
agcacctcctgggaggcg

SEQ ID NO: 801 - DNA, 18 bp, Artificial sequence
  Synthetic oligonucleotide
ggtggcatgtggaccagg

SEQ ID NO: 802 - DNA, 18 bp, Artificial sequence
  Synthetic oligonucleotide
tgtggctctgaggtctcc

SEQ ID NO: 803 - DNA, 18 bp, Artificial sequence
  Synthetic oligonucleotide
gcctctgtcttaactttt

SEQ ID NO: 804 - DNA, 18 bp, Artificial sequence
  Synthetic oligonucleotide
ttagggtacagtggtgtg

SEQ ID NO: 805 - DNA, 18 bp, Artificial sequence
  Synthetic oligonucleotide
cctctagtaggccagtat

SEQ ID NO: 806 - DNA, 18 bp, Artificial sequence
  Synthetic oligonucleotide
aatcaagtaagtttggga

SEQ ID NO: 807 - DNA, 18 bp, Artificial sequence
  Synthetic oligonucleotide
caactgggtctgtaagcc

SEQ ID NO: 808 - DNA, 18 bp, Artificial sequence
  Synthetic oligonucleotide
tagattttcttctttggt

SEQ ID NO: 809 - DNA, 18 bp, Artificial sequence
  Synthetic oligonucleotide
gggcacgaattctcactg

SEQ ID NO: 810 - DNA, 18 bp, Artificial sequence
  Synthetic oligonucleotide
tccagaataggagaggct

SEQ ID NO: 811 - DNA, 18 bp, Artificial sequence
  Synthetic oligonucleotide
acactgcagccaggcttg

SEQ ID NO: 812 - DNA, 18 bp, Artificial sequence
  Synthetic oligonucleotide
tgcagtctccctaaccca

SEQ ID NO: 813 - DNA, 18 bp, Artificial sequence
  Synthetic oligonucleotide
ctcttttcccttgaatct

SEQ ID NO: 814 - DNA, 18 bp, Artificial sequence
  Synthetic oligonucleotide
gtcagcttaccttggctt

SEQ ID NO: 815 - DNA, 18 bp, Artificial sequence
  Synthetic oligonucleotide
caactgctcttccctggg

SEQ ID NO: 816 - DNA, 18 bp, Artificial sequence
  Synthetic oligonucleotide
tctgggtgcagtttatgc

SEQ ID NO: 817 - DNA, 18 bp, Artificial sequence
  Synthetic oligonucleotide
agaatttatgctggaaat

SEQ ID NO: 818 - DNA, 18 bp, Artificial sequence
  Synthetic oligonucleotide
ggccagctctccaaatcc

SEQ ID NO: 819 - DNA, 18 bp, Artificial sequence
  Synthetic oligonucleotide
ccctagactctgggcaac

SEQ ID NO: 820 - DNA, 18 bp, Artificial sequence
  Synthetic oligonucleotide
tctaagtaattcgatatg

SEQ ID NO: 821 - DNA, 18 bp, Artificial sequence
  Synthetic oligonucleotide
aaacagaaactagggtgg

SEQ ID NO: 822 - DNA, 18 bp, Artificial sequence
  Synthetic oligonucleotide
tcccgctgggatccatgg

SEQ ID NO: 823 - DNA, 18 bp, Artificial sequence
  Synthetic oligonucleotide
tgttgccattgggcagcc

SEQ ID NO: 824 - DNA, 18 bp, Artificial sequence
  Synthetic oligonucleotide
gaccttctaattagtcca

SEQ ID NO: 825 - DNA, 18 bp, Artificial sequence
  Synthetic oligonucleotide
gcgattctctcctgtctc

SEQ ID NO: 826 - DNA, 18 bp, Artificial sequence
  Synthetic oligonucleotide
actcagatttattatttt

SEQ ID NO: 827 - DNA, 18 bp, Artificial sequence
  Synthetic oligonucleotide
aaagtactatccacttgt

SEQ ID NO: 828 - DNA, 18 bp, Artificial sequence
  Synthetic oligonucleotide
caaatcctgggttcgaat

SEQ ID NO: 829 - DNA, 18 bp, Artificial sequence
  Synthetic oligonucleotide
aggtctctgcccatgaaa

SEQ ID NO: 830 - DNA, 18 bp, Artificial sequence
  Synthetic oligonucleotide
agatttctcccttcaccc

SEQ ID NO: 831 - DNA, 18 bp, Artificial sequence
  Synthetic oligonucleotide
ttaacatgatggtggttt

SEQ ID NO: 832 - DNA, 18 bp, Artificial sequence
  Synthetic oligonucleotide
cattgtggaaattaaaca

SEQ ID NO: 833 - DNA, 18 bp, Artificial sequence
  Synthetic oligonucleotide
tgtagtcaatattgaact

SEQ ID NO: 834 - DNA, 18 bp, Artificial sequence
  Synthetic oligonucleotide
ttttgagagcaggtctcg

SEQ ID NO: 835 - DNA, 18 bp, Artificial sequence
  Synthetic oligonucleotide
atggcaaacagtacatgt

SEQ ID NO: 836 - DNA, 18 bp, Artificial sequence
  Synthetic oligonucleotide
aggatttaagtgattttc

SEQ ID NO: 837 - DNA, 18 bp, Artificial sequence
  Synthetic oligonucleotide
tacaaagaccccttttcc

SEQ ID NO: 838 - DNA, 18 bp, Artificial sequence
  Synthetic oligonucleotide
agctgccagcagtccttg

SEQ ID NO: 839 - DNA, 18 bp, Artificial sequence
  Synthetic oligonucleotide
ctgctgtaggaaatgacc

SEQ ID NO: 840 - DNA, 18 bp, Artificial sequence
  Synthetic oligonucleotide
agctccaaccagctttct

SEQ ID NO: 841 - DNA, 18 bp, Artificial sequence
  Synthetic oligonucleotide
gtcctgattaacagctaa

SEQ ID NO: 842 - DNA, 18 bp, Artificial sequence
  Synthetic oligonucleotide
gtctgtctgctgccatcc

SEQ ID NO: 843 - DNA, 18 bp, Artificial sequence
  Synthetic oligonucleotide
gtaactgatatggtaaca

SEQ ID NO: 844 - DNA, 18 bp, Artificial sequence
  Synthetic oligonucleotide
agccctctttgtacagga

SEQ ID NO: 845 - DNA, 18 bp, Artificial sequence
  Synthetic oligonucleotide
ctgttccagttgatccag

SEQ ID NO: 846 - DNA, 18 bp, Artificial sequence
  Synthetic oligonucleotide
gcagtctttttaaattaa

SEQ ID NO: 847 - DNA, 18 bp, Artificial sequence
  Synthetic oligonucleotide
cctctgctcacatagaaa

SEQ ID NO: 848 - DNA, 18 bp, Artificial sequence
  Synthetic oligonucleotide
agtacctgccttgttcct

SEQ ID NO: 849 - DNA, 18 bp, Artificial sequence
  Synthetic oligonucleotide
aagcatggtaatacaaaa

SEQ ID NO: 850 - DNA, 18 bp, Artificial sequence
  Synthetic oligonucleotide
ttgattaaaaaaaatagc

SEQ ID NO: 851 - DNA, 18 bp, Artificial sequence
  Synthetic oligonucleotide
ttcatcctttccaagtgt

SEQ ID NO: 852 - DNA, 18 bp, Artificial sequence
  Synthetic oligonucleotide
catgcttacacaccacac

SEQ ID NO: 853 - DNA, 18 bp, Artificial sequence
  Synthetic oligonucleotide
tgcttacacaccacacac

SEQ ID NO: 854 - DNA, 18 bp, Artificial sequence
  Synthetic oligonucleotide
atatgctgaacacacaca

SEQ ID NO: 855 - DNA, 18 bp, Artificial sequence
  Synthetic oligonucleotide
ccaccgaggtctcattgg

SEQ ID NO: 856 - DNA, 18 bp, Artificial sequence
  Synthetic oligonucleotide
gggagacctccctttcaa

SEQ ID NO: 857 - DNA, 18 bp, Artificial sequence
  Synthetic oligonucleotide
tctctgggtgtagagacg

SEQ ID NO: 858 - DNA, 18 bp, Artificial sequence
  Synthetic oligonucleotide
gcaggctcgggctccacg

SEQ ID NO: 859 - DNA, 18 bp, Artificial sequence
  Synthetic oligonucleotide
ccttgtcagatggttgat

SEQ ID NO: 860 - DNA, 18 bp, Artificial sequence
  Synthetic oligonucleotide
tctgcagacttttctcaa

SEQ ID NO: 861 - DNA, 18 bp, Artificial sequence
  Synthetic oligonucleotide
ctggagggaggtgatgtg

SEQ ID NO: 862 - DNA, 18 bp, Artificial sequence
  Synthetic oligonucleotide
gaaagctgctgctgaggg

SEQ ID NO: 863 - DNA, 18 bp, Artificial sequence
  Synthetic oligonucleotide
gggcaaagataattcgaa

SEQ ID NO: 864 - DNA, 18 bp, Artificial sequence
  Synthetic oligonucleotide
cctcaccctgggcaagaa

SEQ ID NO: 865 - DNA, 18 bp, Artificial sequence
  Synthetic oligonucleotide
ttgctgctcgggaggccg

SEQ ID NO: 866 - DNA, 18 bp, Artificial sequence
  Synthetic oligonucleotide
aaatgaaagatgctggct

SEQ ID NO: 867 - DNA, 18 bp, Artificial sequence
  Synthetic oligonucleotide
cagagaggtccagctact

SEQ ID NO: 868 - DNA, 18 bp, Artificial sequence
  Synthetic oligonucleotide
agctcactacagcaggca

SEQ ID NO: 869 - DNA, 18 bp, Artificial sequence
  Synthetic oligonucleotide
tatttcttgcaattcttt

SEQ ID NO: 870 - DNA, 18 bp, Artificial sequence
  Synthetic oligonucleotide
ggaggactgtctctagag

SEQ ID NO: 871 - DNA, 18 bp, Artificial sequence
  Synthetic oligonucleotide
tccggcctggcgaactga

SEQ ID NO: 872 - DNA, 18 bp, Artificial sequence
  Synthetic oligonucleotide
cctgcaaagctaatttta

SEQ ID NO: 873 - DNA, 18 bp, Artificial sequence
  Synthetic oligonucleotide
gagccccctttaagcctt

SEQ ID NO: 874 - DNA, 18 bp, Artificial sequence
  Synthetic oligonucleotide
gtacaaagactgtgtacg

SEQ ID NO: 875 - DNA, 18 bp, Artificial sequence
  Synthetic oligonucleotide
gactcaggaacatgttag

SEQ ID NO: 876 - DNA, 18 bp, Artificial sequence
  Synthetic oligonucleotide
tgaggcagcaatgctggg

SEQ ID NO: 877 - DNA, 18 bp, Artificial sequence
  Synthetic oligonucleotide
cactgggaggtgtataga

SEQ ID NO: 878 - DNA, 18 bp, Artificial sequence
  Synthetic oligonucleotide
gcgaggtgggtgaaggtt

SEQ ID NO: 879 - DNA, 18 bp, Artificial sequence
  Synthetic oligonucleotide
aaaaactttggcagtcag

SEQ ID NO: 880 - DNA, 18 bp, Artificial sequence
  Synthetic oligonucleotide
ggtctgccctgcaccagg

SEQ ID NO: 881 - DNA, 18 bp, Artificial sequence
  Synthetic oligonucleotide
ctgagctctccgagctgc

SEQ ID NO: 882 - DNA, 18 bp, Artificial sequence
  Synthetic oligonucleotide
gtgaggtggtatcattgg

SEQ ID NO: 883 - DNA, 18 bp, Artificial sequence
  Synthetic oligonucleotide
ctagcttgaattcctcca

SEQ ID NO: 884 - DNA, 18 bp, Artificial sequence
  Synthetic oligonucleotide
aatctgtgactcaagaac

SEQ ID NO: 885 - DNA, 18 bp, Artificial sequence
  Synthetic oligonucleotide
gggccgtctctattaaaa

SEQ ID NO: 886 - DNA, 18 bp, Artificial sequence
  Synthetic oligonucleotide
ggtataatttgtttggac

SEQ ID NO: 887 - DNA, 18 bp, Artificial sequence
  Synthetic oligonucleotide
ctttattgcatataggta

SEQ ID NO: 888 - DNA, 18 bp, Artificial sequence
  Synthetic oligonucleotide
atccagtcccaacattgg

SEQ ID NO: 889 - DNA, 18 bp, Artificial sequence
  Synthetic oligonucleotide
cggtctctctgacttgcc

SEQ ID NO: 890 - DNA, 18 bp, Artificial sequence
  Synthetic oligonucleotide
gagggcattcctcaaagg

SEQ ID NO: 891 - DNA, 18 bp, Artificial sequence
  Synthetic oligonucleotide
agttctctgattctcaaa

SEQ ID NO: 892 - DNA, 18 bp, Artificial sequence
  Synthetic oligonucleotide
cccccagtgcccacaagt

SEQ ID NO: 893 - DNA, 18 bp, Artificial sequence
  Synthetic oligonucleotide
ctaaaagctaaagtgggt

SEQ ID NO: 894 - DNA, 18 bp, Artificial sequence
  Synthetic oligonucleotide
aggacctggcagagctgc

SEQ ID NO: 895 - DNA, 18 bp, Artificial sequence
  Synthetic oligonucleotide
aaatcgaacacttacata

SEQ ID NO: 896 - DNA, 18 bp, Artificial sequence
  Synthetic oligonucleotide
ttgccatcttggacaggg

SEQ ID NO: 897 - DNA, 18 bp, Artificial sequence
  Synthetic oligonucleotide
acaccttcatttactgtc

SEQ ID NO: 898 - DNA, 18 bp, Artificial sequence
  Synthetic oligonucleotide
ttttcaaacacaccttca

SEQ ID NO: 899 - DNA, 18 bp, Artificial sequence
  Synthetic oligonucleotide
ggttttcaaacacacctt

SEQ ID NO: 900 - DNA, 18 bp, Artificial sequence
  Synthetic oligonucleotide
tggttttcaaacacacct

SEQ ID NO: 901 - DNA, 18 bp, Artificial sequence
  Synthetic oligonucleotide
tacctgatagtcgacaga

SEQ ID NO: 902 - DNA, 18 bp, Artificial sequence
  Synthetic oligonucleotide
gtccctttccaggccgcc

SEQ ID NO: 903 - DNA, 18 bp, Artificial sequence
  Synthetic oligonucleotide
cgcccattgcggcaaaag

SEQ ID NO: 904 - DNA, 18 bp, Artificial sequence
  Synthetic oligonucleotide
cactgctcgggaggtgca

SEQ ID NO: 905 - DNA, 18 bp, Artificial sequence
  Synthetic oligonucleotide
tgttctcaggcacggcgc

SEQ ID NO: 906 - DNA, 18 bp, Artificial sequence
  Synthetic oligonucleotide
gccctgcgctccgagcgc

SEQ ID NO: 907 - DNA, 18 bp, Artificial sequence
  Synthetic oligonucleotide
aaaaaagatggcacctcg

SEQ ID NO: 908 - DNA, 18 bp, Artificial sequence
  Synthetic oligonucleotide
acaaagcaaagagccccc

SEQ ID NO: 909 - DNA, 18 bp, Artificial sequence
  Synthetic oligonucleotide
tcacgcccgttccatgcg

SEQ ID NO: 910 - DNA, 18 bp, Artificial sequence
  Synthetic oligonucleotide
ccggatgggtagccagcg

SEQ ID NO: 911 - DNA, 18 bp, Artificial sequence
  Synthetic oligonucleotide
ccctctccggacacctgt

SEQ ID NO: 912 - DNA, 18 bp, Artificial sequence
  Synthetic oligonucleotide
aaatacacccagggccgc

SEQ ID NO: 913 - DNA, 18 bp, Artificial sequence
  Synthetic oligonucleotide
gatagaattaaccagaaa

SEQ ID NO: 914 - DNA, 18 bp, Artificial sequence
  Synthetic oligonucleotide
agcctcgcagtacccagg

SEQ ID NO: 915 - DNA, 18 bp, Artificial sequence
  Synthetic oligonucleotide
tcgcgagatggcaatacg

SEQ ID NO: 916 - DNA, 18 bp, Artificial sequence
  Synthetic oligonucleotide
ttcctccattaacagcgc

SEQ ID NO: 917 - DNA, 18 bp, Artificial sequence
  Synthetic oligonucleotide
cccgcctgctgggaatgg

SEQ ID NO: 918 - DNA, 18 bp, Artificial sequence
  Synthetic oligonucleotide
agaactcaaattggtcct

SEQ ID NO: 919 - DNA, 18 bp, Artificial sequence
  Synthetic oligonucleotide
tataagcagcttatacag

SEQ ID NO: 920 - DNA, 18 bp, Artificial sequence
  Synthetic oligonucleotide
ccaagccaggttattgct

SEQ ID NO: 921 - DNA, 18 bp, Artificial sequence
  Synthetic oligonucleotide
tctaacaatttatgggca

SEQ ID NO: 922 - DNA, 18 bp, Artificial sequence
  Synthetic oligonucleotide
aacaaatggactgtaaca

SEQ ID NO: 923 - DNA, 18 bp, Artificial sequence
  Synthetic oligonucleotide
ttcaaggagggagtaagg

SEQ ID NO: 924 - DNA, 18 bp, Artificial sequence
  Synthetic oligonucleotide
aggaaagtggtggtggag

SEQ ID NO: 925 - DNA, 18 bp, Artificial sequence
  Synthetic oligonucleotide
tgcagcccagctggtgag

SEQ ID NO: 926 - DNA, 18 bp, Artificial sequence
  Synthetic oligonucleotide
tccttgtaggatgtttaa

SEQ ID NO: 927 - DNA, 18 bp, Artificial sequence
  Synthetic oligonucleotide
acctgctacatagcggaa

SEQ ID NO: 928 - DNA, 18 bp, Artificial sequence
  Synthetic oligonucleotide
ttatagatcatatctggg

SEQ ID NO: 929 - DNA, 18 bp, Artificial sequence
  Synthetic oligonucleotide
aaacagagcaccaatgta

SEQ ID NO: 930 - DNA, 18 bp, Artificial sequence
  Synthetic oligonucleotide
acctcagagacttgacct

SEQ ID NO: 931 - DNA, 18 bp, Artificial sequence
  Synthetic oligonucleotide
cccaggaagtgagaaaag

SEQ ID NO: 932 - DNA, 18 bp, Artificial sequence
  Synthetic oligonucleotide
cagttgggagccatctgg

SEQ ID NO: 933 - DNA, 18 bp, Artificial sequence
  Synthetic oligonucleotide
attgggctcagcatggag

SEQ ID NO: 934 - DNA, 18 bp, Artificial sequence
  Synthetic oligonucleotide
tccttaaccattaggcca

SEQ ID NO: 935 - DNA, 18 bp, Artificial sequence
  Synthetic oligonucleotide
tggccctagtgagtaccg

SEQ ID NO: 936 - DNA, 18 bp, Artificial sequence
  Synthetic oligonucleotide
gcccagtttggtgcaggg

SEQ ID NO: 937 - DNA, 18 bp, Artificial sequence
  Synthetic oligonucleotide
ggcgggaaggcaggtcag

SEQ ID NO: 938 - DNA, 18 bp, Artificial sequence
  Synthetic oligonucleotide
cagtttaccaatgtcagc

SEQ ID NO: 939 - DNA, 18 bp, Artificial sequence
  Synthetic oligonucleotide
atatattgttacttagtc

SEQ ID NO: 940 - DNA, 18 bp, Artificial sequence
  Synthetic oligonucleotide
cataggcaaaacagacaa

SEQ ID NO: 941 - DNA, 18 bp, Artificial sequence
  Synthetic oligonucleotide
tagttgaatgttttggaa

SEQ ID NO: 942 - DNA, 18 bp, Artificial sequence
  Synthetic oligonucleotide
acggcggaggctgaggcg

SEQ ID NO: 943 - DNA, 18 bp, Artificial sequence
  Synthetic oligonucleotide
aggtgcaagctggccggg

SEQ ID NO: 944 - DNA, 18 bp, Artificial sequence
  Synthetic oligonucleotide
tgataccctgtaagaata

SEQ ID NO: 945 - DNA, 18 bp, Artificial sequence
  Synthetic oligonucleotide
aatatagcaaagggaatt

SEQ ID NO: 946 - DNA, 18 bp, Artificial sequence
  Synthetic oligonucleotide
tagagataattatgtccc

SEQ ID NO: 947 - DNA, 18 bp, Artificial sequence
  Synthetic oligonucleotide
gcaattacagagccaggg

SEQ ID NO: 948 - DNA, 18 bp, Artificial sequence
  Synthetic oligonucleotide
gcagaactggatccgatc

SEQ ID NO: 949 - DNA, 18 bp, Artificial sequence
  Synthetic oligonucleotide
caaagccaggatggtctc

SEQ ID NO: 950 - DNA, 18 bp, Artificial sequence
  Synthetic oligonucleotide
ccaaagagattccttttt

SEQ ID NO: 951 - DNA, 18 bp, Artificial sequence
  Synthetic oligonucleotide
ggcctcatttatatatat

SEQ ID NO: 952 - DNA, 18 bp, Artificial sequence
  Synthetic oligonucleotide
tatgggacaatcatagct

SEQ ID NO: 953 - DNA, 18 bp, Artificial sequence
  Synthetic oligonucleotide
aattctgatacattgtca

SEQ ID NO: 954 - DNA, 18 bp, Artificial sequence
  Synthetic oligonucleotide
gatgactcttccaaatgg

SEQ ID NO: 955 - DNA, 18 bp, Artificial sequence
  Synthetic oligonucleotide
tcacttcattattcaagc

SEQ ID NO: 956 - DNA, 18 bp, Artificial sequence
  Synthetic oligonucleotide
gtgcagccgccactggcc

SEQ ID NO: 957 - DNA, 18 bp, Artificial sequence
  Synthetic oligonucleotide
cgataagatctttttaaa

SEQ ID NO: 958 - DNA, 18 bp, Artificial sequence
  Synthetic oligonucleotide
gacagtataatctccatt

SEQ ID NO: 959 - DNA, 18 bp, Artificial sequence
  Synthetic oligonucleotide
aggctaaagtcagcccac

SEQ ID NO: 960 - DNA, 18 bp, Artificial sequence
  Synthetic oligonucleotide
cttgcaccctggtttggg

SEQ ID NO: 961 - DNA, 18 bp, Artificial sequence
  Synthetic oligonucleotide
tccctgtctggttaggaa

SEQ ID NO: 962 - DNA, 18 bp, Artificial sequence
  Synthetic oligonucleotide
acgcgcctgccccgtgcc

SEQ ID NO: 963 - DNA, 18 bp, Artificial sequence
  Synthetic oligonucleotide
ctcaaacctggccacgct

SEQ ID NO: 964 - DNA, 18 bp, Artificial sequence
  Synthetic oligonucleotide
gaaactggcgggtctgtt

SEQ ID NO: 965 - DNA, 18 bp, Artificial sequence
  Synthetic oligonucleotide
gggaggaatttggcaatg

SEQ ID NO: 966 - DNA, 18 bp, Artificial sequence
  Synthetic oligonucleotide
aaagagcacggcatctat

SEQ ID NO: 967 - DNA, 18 bp, Artificial sequence
  Synthetic oligonucleotide
aaactgtgaggcactggg

SEQ ID NO: 968 - DNA, 18 bp, Artificial sequence
  Synthetic oligonucleotide
catttgacattggcctgt

SEQ ID NO: 969 - DNA, 18 bp, Artificial sequence
  Synthetic oligonucleotide
attattatcagcatcttc

SEQ ID NO: 970 - DNA, 18 bp, Artificial sequence
  Synthetic oligonucleotide
ttgcagaggcaggaaggc

SEQ ID NO: 971 - DNA, 18 bp, Artificial sequence
  Synthetic oligonucleotide
agcagcctggtttagagg

SEQ ID NO: 972 - DNA, 18 bp, Artificial sequence
  Synthetic oligonucleotide
tccacatcttccagcctc

SEQ ID NO: 973 - DNA, 18 bp, Artificial sequence
  Synthetic oligonucleotide
atacagactcagtctcct

SEQ ID NO: 974 - DNA, 18 bp, Artificial sequence
  Synthetic oligonucleotide
agtcgaccgcactcctgc

SEQ ID NO: 975 - DNA, 18 bp, Artificial sequence
  Synthetic oligonucleotide
gccctgagggtccacagg

SEQ ID NO: 976 - DNA, 18 bp, Artificial sequence
  Synthetic oligonucleotide
agggcagtgtcctacctc

SEQ ID NO: 977 - DNA, 18 bp, Artificial sequence
  Synthetic oligonucleotide
gtcctcccttccccacaa

SEQ ID NO: 978 - DNA, 18 bp, Artificial sequence
  Synthetic oligonucleotide
ctgaattcctatcatgcg

SEQ ID NO: 979 - DNA, 18 bp, Artificial sequence
  Synthetic oligonucleotide
gagaaagaagagtgtggt

SEQ ID NO: 980 - DNA, 18 bp, Artificial sequence
  Synthetic oligonucleotide
cttaggacagattcctag

SEQ ID NO: 981 - DNA, 18 bp, Artificial sequence
  Synthetic oligonucleotide
gtcagaagtgttttccca

SEQ ID NO: 982 - DNA, 18 bp, Artificial sequence
  Synthetic oligonucleotide
tccaattttaaacttaaa

SEQ ID NO: 983 - DNA, 18 bp, Artificial sequence
  Synthetic oligonucleotide
ctactgtttaaaaaggct

SEQ ID NO: 984 - DNA, 18 bp, Artificial sequence
  Synthetic oligonucleotide
gtaaacaccatctctaaa

SEQ ID NO: 985 - DNA, 18 bp, Artificial sequence
  Synthetic oligonucleotide
ctctgatactattataag

SEQ ID NO: 986 - DNA, 18 bp, Artificial sequence
  Synthetic oligonucleotide
ctgagctatttgagaatt

SEQ ID NO: 987 - DNA, 18 bp, Artificial sequence
  Synthetic oligonucleotide
tctgcatatataattata

SEQ ID NO: 988 - DNA, 18 bp, Artificial sequence
  Synthetic oligonucleotide
cacattgtttagattttc

SEQ ID NO: 989 - DNA, 18 bp, Artificial sequence
  Synthetic oligonucleotide
ttagcacacctgaaacgc

SEQ ID NO: 990 - DNA, 18 bp, Artificial sequence
  Synthetic oligonucleotide
ggcaaagaagacaggaga

SEQ ID NO: 991 - DNA, 18 bp, Artificial sequence
  Synthetic oligonucleotide
tgctgaggatgctttttt

SEQ ID NO: 992 - DNA, 18 bp, Artificial sequence
  Synthetic oligonucleotide
gctggaagatgaggtggt

SEQ ID NO: 993 - DNA, 18 bp, Artificial sequence
  Synthetic oligonucleotide
tgggtgttggagaaaact

SEQ ID NO: 994 - DNA, 18 bp, Artificial sequence
  Synthetic oligonucleotide
gctttaaaagctcctcag

SEQ ID NO: 995 - DNA, 18 bp, Artificial sequence
  Synthetic oligonucleotide
cgagcacttgtagttcca

SEQ ID NO: 996 - DNA, 18 bp, Artificial sequence
  Synthetic oligonucleotide
gcagtgctttaaaaatat

SEQ ID NO: 997 - DNA, 18 bp, Artificial sequence
  Synthetic oligonucleotide
gaaatttcatgaaatatg

SEQ ID NO: 998 - DNA, 18 bp, Artificial sequence
  Synthetic oligonucleotide
ttacttgcaattgaaaga

SEQ ID NO: 999 - DNA, 18 bp, Artificial sequence
  Synthetic oligonucleotide
ggaaagactactcagagc

SEQ ID NO: 1000 - DNA, 18 bp, Artificial sequence
  Synthetic oligonucleotide
gatgaaagagaataacaa

SEQ ID NO: 1001 - DNA, 18 bp, Artificial sequence
  Synthetic oligonucleotide
acccattatctgctcccc

SEQ ID NO: 1002 - DNA, 18 bp, Artificial sequence
  Synthetic oligonucleotide
ttttcagtaacaacataa

SEQ ID NO: 1003 - DNA, 18 bp, Artificial sequence
  Synthetic oligonucleotide
cctttagctttccttttc

SEQ ID NO: 1004 - DNA, 18 bp, Artificial sequence
  Synthetic oligonucleotide
caaattctgtttctgtaa

SEQ ID NO: 1005 - DNA, 18 bp, Artificial sequence
  Synthetic oligonucleotide
gcaaaaataagtgaactg

SEQ ID NO: 1006 - DNA, 18 bp, Artificial sequence
  Synthetic oligonucleotide
ttgcagtgacttcttggg

SEQ ID NO: 1007 - DNA, 18 bp, Artificial sequence
  Synthetic oligonucleotide
aaaccccttcaacatcag

SEQ ID NO: 1008 - DNA, 18 bp, Artificial sequence
  Synthetic oligonucleotide
acaagagaaacattttac

SEQ ID NO: 1009 - DNA, 18 bp, Artificial sequence
  Synthetic oligonucleotide
cacttagtaaccaagcaa

SEQ ID NO: 1010 - DNA, 18 bp, Artificial sequence
  Synthetic oligonucleotide
catagatgatatattttg

SEQ ID NO: 1011 - DNA, 18 bp, Artificial sequence
  Synthetic oligonucleotide
aaatcttgaactcctgaa

SEQ ID NO: 1012 - DNA, 18 bp, Artificial sequence
  Synthetic oligonucleotide
ggagtttttgtgtttctt

SEQ ID NO: 1013 - DNA, 18 bp, Artificial sequence
  Synthetic oligonucleotide
aaattcttaatggttcag

SEQ ID NO: 1014 - DNA, 18 bp, Artificial sequence
  Synthetic oligonucleotide
agatagatctcggctcac

SEQ ID NO: 1015 - DNA, 18 bp, Artificial sequence
  Synthetic oligonucleotide
aacctttaataaactttt

SEQ ID NO: 1016 - DNA, 18 bp, Artificial sequence
  Synthetic oligonucleotide
gtccaagaggtttttttt

SEQ ID NO: 1017 - DNA, 18 bp, Artificial sequence
  Synthetic oligonucleotide
gcagtcactgcattccag

SEQ ID NO: 1018 - DNA, 18 bp, Artificial sequence
  Synthetic oligonucleotide
caaaaacagggctaggca

SEQ ID NO: 1019 - DNA, 18 bp, Artificial sequence
  Synthetic oligonucleotide
ttccctgaacaaatggca

SEQ ID NO: 1020 - DNA, 18 bp, Artificial sequence
  Synthetic oligonucleotide
ctcaaatgtaacatttta

SEQ ID NO: 1021 - DNA, 18 bp, Artificial sequence
  Synthetic oligonucleotide
tacacctggcccatgacc

SEQ ID NO: 1022 - DNA, 18 bp, Artificial sequence
  Synthetic oligonucleotide
aagttctggctcaagcaa

SEQ ID NO: 1023 - DNA, 18 bp, Artificial sequence
  Synthetic oligonucleotide
acaactctctggaaaaaa

SEQ ID NO: 1024 - DNA, 18 bp, Artificial sequence
  Synthetic oligonucleotide
agtccacgcctgcatctg

SEQ ID NO: 1025 - DNA, 18 bp, Artificial sequence
  Synthetic oligonucleotide
caaggcaacagagaggca

SEQ ID NO: 1026 - DNA, 18 bp, Artificial sequence
  Synthetic oligonucleotide
aacatgcatataattacc

SEQ ID NO: 1027 - DNA, 18 bp, Artificial sequence
  Synthetic oligonucleotide
ttggagggacaattctca

SEQ ID NO: 1028 - DNA, 18 bp, Artificial sequence
  Synthetic oligonucleotide
cgaagaggccaggactgc

SEQ ID NO: 1029 - DNA, 18 bp, Artificial sequence
  Synthetic oligonucleotide
tttggctctggtgatggt

SEQ ID NO: 1030 - DNA, 18 bp, Artificial sequence
  Synthetic oligonucleotide
accaggcaaagggacacc

SEQ ID NO: 1031 - DNA, 18 bp, Artificial sequence
  Synthetic oligonucleotide
tgccagagacagaggttg

SEQ ID NO: 1032 - DNA, 18 bp, Artificial sequence
  Synthetic oligonucleotide
cacacgcatggcttcatg

SEQ ID NO: 1033 - DNA, 18 bp, Artificial sequence
  Synthetic oligonucleotide
gaggaaggcatgaactaa

SEQ ID NO: 1034 - DNA, 18 bp, Artificial sequence
  Synthetic oligonucleotide
tcccatgcccacgcatgt

SEQ ID NO: 1035 - DNA, 18 bp, Artificial sequence
  Synthetic oligonucleotide
attattaacgaacaaaaa

SEQ ID NO: 1036 - DNA, 18 bp, Artificial sequence
  Synthetic oligonucleotide
atgtccagatgtggatcg

SEQ ID NO: 1037 - DNA, 18 bp, Artificial sequence
  Synthetic oligonucleotide
atcagacagaagagccat

SEQ ID NO: 1038 - DNA, 18 bp, Artificial sequence
  Synthetic oligonucleotide
gcacagtgcaacagtggg

SEQ ID NO: 1039 - DNA, 18 bp, Artificial sequence
  Synthetic oligonucleotide
ggctttcccttcccttct

SEQ ID NO: 1040 - DNA, 18 bp, Artificial sequence
  Synthetic oligonucleotide
agctgggaaagtggcagg

SEQ ID NO: 1041 - DNA, 18 bp, Artificial sequence
  Synthetic oligonucleotide
atgacaacttgatttggg

SEQ ID NO: 1042 - DNA, 18 bp, Artificial sequence
  Synthetic oligonucleotide
gaccgcaaccttgccaaa

SEQ ID NO: 1043 - DNA, 18 bp, Artificial sequence
  Synthetic oligonucleotide
ctttcagagacaggctcg

SEQ ID NO: 1044 - DNA, 18 bp, Artificial sequence
  Synthetic oligonucleotide
gggctcacccctgtagtt

SEQ ID NO: 1045 - DNA, 18 bp, Artificial sequence
  Synthetic oligonucleotide
ctcttaaggccgagtgca

SEQ ID NO: 1046 - DNA, 18 bp, Artificial sequence
  Synthetic oligonucleotide
tgctaggcaaaaaaacaa

SEQ ID NO: 1047 - DNA, 18 bp, Artificial sequence
  Synthetic oligonucleotide
taattagaaacctcctcg

SEQ ID NO: 1048 - DNA, 18 bp, Artificial sequence
  Synthetic oligonucleotide
caggtcatatatgaaatc

SEQ ID NO: 1049 - DNA, 18 bp, Artificial sequence
  Synthetic oligonucleotide
tgtgcttccgaaagtagt

SEQ ID NO: 1050 - DNA, 18 bp, Artificial sequence
  Synthetic oligonucleotide
gcatcaaatccatgcatt

SEQ ID NO: 1051 - DNA, 18 bp, Artificial sequence
  Synthetic oligonucleotide
actctgaagcacagacag

SEQ ID NO: 1052 - DNA, 18 bp, Artificial sequence
  Synthetic oligonucleotide
cttacctgggctggatgg

SEQ ID NO: 1053 - DNA, 18 bp, Artificial sequence
  Synthetic oligonucleotide
ttctgtctatagctagaa

SEQ ID NO: 1054 - DNA, 18 bp, Artificial sequence
  Synthetic oligonucleotide
agatggcttcctattgtt

SEQ ID NO: 1055 - DNA, 18 bp, Artificial sequence
  Synthetic oligonucleotide
tggtttggtcaggcctca

SEQ ID NO: 1056 - DNA, 18 bp, Artificial sequence
  Synthetic oligonucleotide
attgtaactcaaagtggg

SEQ ID NO: 1057 - DNA, 18 bp, Artificial sequence
  Synthetic oligonucleotide
aaactctacacccctggg

SEQ ID NO: 1058 - DNA, 18 bp, Artificial sequence
  Synthetic oligonucleotide
cataccaggaaggaagga

SEQ ID NO: 1059 - DNA, 18 bp, Artificial sequence
  Synthetic oligonucleotide
tggacatatcagaatttg

SEQ ID NO: 1060 - DNA, 18 bp, Artificial sequence
  Synthetic oligonucleotide
cccttattagtgtctaca

SEQ ID NO: 1061 - DNA, 18 bp, Artificial sequence
  Synthetic oligonucleotide
acactctagagaggtcca

SEQ ID NO: 1062 - DNA, 18 bp, Artificial sequence
  Synthetic oligonucleotide
gacagtacccacgacacg

SEQ ID NO: 1063 - DNA, 18 bp, Artificial sequence
  Synthetic oligonucleotide
ccccattctggatcctgg

SEQ ID NO: 1064 - DNA, 18 bp, Artificial sequence
  Synthetic oligonucleotide
attgtctgtaaaatgtgg

SEQ ID NO: 1065 - DNA, 18 bp, Artificial sequence
  Synthetic oligonucleotide
attctgtctgacagagac

SEQ ID NO: 1066 - DNA, 18 bp, Artificial sequence
  Synthetic oligonucleotide
cgatggtgcacatctata

SEQ ID NO: 1067 - DNA, 18 bp, Artificial sequence
  Synthetic oligonucleotide
cagtgtccgctgaacaca

SEQ ID NO: 1068 - DNA, 18 bp, Artificial sequence
  Synthetic oligonucleotide
aggaggattaggaagaaa

SEQ ID NO: 1069 - DNA, 18 bp, Artificial sequence
  Synthetic oligonucleotide
caaggaaggcgatctggg

SEQ ID NO: 1070 - DNA, 18 bp, Artificial sequence
  Synthetic oligonucleotide
ggtggcacttgaacaagc

SEQ ID NO: 1071 - DNA, 18 bp, Artificial sequence
  Synthetic oligonucleotide
ggtggaaagggaacccgg

SEQ ID NO: 1072 - DNA, 18 bp, Artificial sequence
  Synthetic oligonucleotide
ccccacgggtacacagag

SEQ ID NO: 1073 - DNA, 18 bp, Artificial sequence
  Synthetic oligonucleotide
cgctgcgaacgatgcact

SEQ ID NO: 1074 - DNA, 18 bp, Artificial sequence
  Synthetic oligonucleotide
gaatggtccttcttacag

SEQ ID NO: 1075 - DNA, 18 bp, Artificial sequence
  Synthetic oligonucleotide
ctgggaaaaccaaggcaa

SEQ ID NO: 1076 - DNA, 18 bp, Artificial sequence
  Synthetic oligonucleotide
cccaggctgaggaaggac

SEQ ID NO: 1077 - DNA, 18 bp, Artificial sequence
  Synthetic oligonucleotide
gattggcttttacatctt

SEQ ID NO: 1078 - DNA, 18 bp, Artificial sequence
  Synthetic oligonucleotide
cggtttgagtacagtggt

SEQ ID NO: 1079 - DNA, 18 bp, Artificial sequence
  Synthetic oligonucleotide
ctaacatcttagggcaca

SEQ ID NO: 1080 - DNA, 18 bp, Artificial sequence
  Synthetic oligonucleotide
ttcctctgatgtcagaat

SEQ ID NO: 1081 - DNA, 18 bp, Artificial sequence
  Synthetic oligonucleotide
ccccctcggtcgcccagg

SEQ ID NO: 1082 - DNA, 18 bp, Artificial sequence
  Synthetic oligonucleotide
tgttttaactaaaagctt

SEQ ID NO: 1083 - DNA, 18 bp, Artificial sequence
  Synthetic oligonucleotide
gtatgagggcatagatga

SEQ ID NO: 1084 - DNA, 18 bp, Artificial sequence
  Synthetic oligonucleotide
atcacaccacagaatgtt

SEQ ID NO: 1085 - DNA, 18 bp, Artificial sequence
  Synthetic oligonucleotide
tactcttctgtggcagct

SEQ ID NO: 1086 - DNA, 18 bp, Artificial sequence
  Synthetic oligonucleotide
caacagcaaggccaggcg

SEQ ID NO: 1087 - DNA, 18 bp, Artificial sequence
  Synthetic oligonucleotide
tagataatttgaaattta

SEQ ID NO: 1088 - DNA, 18 bp, Artificial sequence
  Synthetic oligonucleotide
accttaatcccagtattt

SEQ ID NO: 1089 - DNA, 18 bp, Artificial sequence
  Synthetic oligonucleotide
tgcttatggtccagctgt

SEQ ID NO: 1090 - DNA, 18 bp, Artificial sequence
  Synthetic oligonucleotide
gagccaggcttcaaaacc

SEQ ID NO: 1091 - DNA, 18 bp, Artificial sequence
  Synthetic oligonucleotide
tccagcacatttaggcgg

SEQ ID NO: 1092 - DNA, 18 bp, Artificial sequence
  Synthetic oligonucleotide
atctcaataaagctatcg

SEQ ID NO: 1093 - DNA, 18 bp, Artificial sequence
  Synthetic oligonucleotide
cgcccgcggtgactcagc

SEQ ID NO: 1094 - DNA, 18 bp, Artificial sequence
  Synthetic oligonucleotide
ggagtcaagagtccaggg

SEQ ID NO: 1095 - DNA, 18 bp, Artificial sequence
  Synthetic oligonucleotide
agaaggaatgatgaggaa

SEQ ID NO: 1096 - DNA, 18 bp, Artificial sequence
  Synthetic oligonucleotide
gcagtacagtttggtaat

SEQ ID NO: 1097 - DNA, 18 bp, Artificial sequence
  Synthetic oligonucleotide
tggctactctctcaggag

SEQ ID NO: 1098 - DNA, 18 bp, Artificial sequence
  Synthetic oligonucleotide
gaccctaggtgggtaaag

SEQ ID NO: 1099 - DNA, 18 bp, Artificial sequence
  Synthetic oligonucleotide
gtcccctgaggtgttgtg

SEQ ID NO: 1100 - DNA, 18 bp, Artificial sequence
  Synthetic oligonucleotide
cccagacaaccttcacct

SEQ ID NO: 1101 - DNA, 18 bp, Artificial sequence
  Synthetic oligonucleotide
tgggttaagactctgtct

SEQ ID NO: 1102 - DNA, 18 bp, Artificial sequence
  Synthetic oligonucleotide
tggagccgagtgcggtgg

SEQ ID NO: 1103 - DNA, 18 bp, Artificial sequence
  Synthetic oligonucleotide
tctcttctggatatttcg

SEQ ID NO: 1104 - DNA, 18 bp, Artificial sequence
  Synthetic oligonucleotide
cgatttaaaatgaatgat

SEQ ID NO: 1105 - DNA, 18 bp, Artificial sequence
  Synthetic oligonucleotide
agaacaaagataacagtt

SEQ ID NO: 1106 - DNA, 18 bp, Artificial sequence
  Synthetic oligonucleotide
gctaaattgaggcccggg

SEQ ID NO: 1107 - DNA, 18 bp, Artificial sequence
  Synthetic oligonucleotide
ctttctcctttcctcaat

SEQ ID NO: 1108 - DNA, 18 bp, Artificial sequence
  Synthetic oligonucleotide
tctaagcgagacacacag

SEQ ID NO: 1109 - DNA, 18 bp, Artificial sequence
  Synthetic oligonucleotide
tgatttctctggaagaac

SEQ ID NO: 1110 - DNA, 18 bp, Artificial sequence
  Synthetic oligonucleotide
gcctgtgtcttctaactc

SEQ ID NO: 1111 - DNA, 18 bp, Artificial sequence
  Synthetic oligonucleotide
ggctgagaagctgggacc

SEQ ID NO: 1112 - DNA, 18 bp, Artificial sequence
  Synthetic oligonucleotide
tttttacttgagatgtca

SEQ ID NO: 1113 - DNA, 18 bp, Artificial sequence
  Synthetic oligonucleotide
gtaggtgtcatcatcatc

SEQ ID NO: 1114 - DNA, 18 bp, Artificial sequence
  Synthetic oligonucleotide
caacactgactgagcaca

SEQ ID NO: 1115 - DNA, 18 bp, Artificial sequence
  Synthetic oligonucleotide
gcattggctgggctaggt

SEQ ID NO: 1116 - DNA, 18 bp, Artificial sequence
  Synthetic oligonucleotide
tatttactatgcaaaata

SEQ ID NO: 1117 - DNA, 18 bp, Artificial sequence
  Synthetic oligonucleotide
agcaccacagagcagatg

SEQ ID NO: 1118 - DNA, 18 bp, Artificial sequence
  Synthetic oligonucleotide
ctcagtgtggagttctgc

SEQ ID NO: 1119 - DNA, 18 bp, Artificial sequence
  Synthetic oligonucleotide
catttttcaaccacttaa

SEQ ID NO: 1120 - DNA, 18 bp, Artificial sequence
  Synthetic oligonucleotide
gtaaggctttgtgggcca

SEQ ID NO: 1121 - DNA, 18 bp, Artificial sequence
  Synthetic oligonucleotide
tactttgcattatttatt

SEQ ID NO: 1122 - DNA, 18 bp, Artificial sequence
  Synthetic oligonucleotide
ttggctttcattataatt

SEQ ID NO: 1123 - DNA, 18 bp, Artificial sequence
  Synthetic oligonucleotide
ggacggttgggaaatagg

SEQ ID NO: 1124 - DNA, 18 bp, Artificial sequence
  Synthetic oligonucleotide
gagcaactgttcataggg

SEQ ID NO: 1125 - DNA, 18 bp, Artificial sequence
  Synthetic oligonucleotide
tctgcacatcgacacatc

SEQ ID NO: 1126 - DNA, 18 bp, Artificial sequence
  Synthetic oligonucleotide
aggctaggccccatggct

SEQ ID NO: 1127 - DNA, 18 bp, Artificial sequence
  Synthetic oligonucleotide
gcacccccatccttcagc

SEQ ID NO: 1128 - DNA, 18 bp, Artificial sequence
  Synthetic oligonucleotide
ccaggagatgaagtagca

SEQ ID NO: 1129 - DNA, 18 bp, Artificial sequence
  Synthetic oligonucleotide
actcttgggaaacaaagt

SEQ ID NO: 1130 - DNA, 18 bp, Artificial sequence
  Synthetic oligonucleotide
ggaagcagccagggacgg

SEQ ID NO: 1131 - DNA, 18 bp, Artificial sequence
  Synthetic oligonucleotide
ctgcctggccaattaaat

SEQ ID NO: 1132 - DNA, 18 bp, Artificial sequence
  Synthetic oligonucleotide
caaactaatattaacact

SEQ ID NO: 1133 - DNA, 18 bp, Artificial sequence
  Synthetic oligonucleotide
tactcaattccaggcaag

SEQ ID NO: 1134 - DNA, 18 bp, Artificial sequence
  Synthetic oligonucleotide
aatggaagttctagtacg

SEQ ID NO: 1135 - DNA, 18 bp, Artificial sequence
  Synthetic oligonucleotide
caatcacagttctttttc

SEQ ID NO: 1136 - DNA, 18 bp, Artificial sequence
  Synthetic oligonucleotide
gtcttaaacataaacata

SEQ ID NO: 1137 - DNA, 18 bp, Artificial sequence
  Synthetic oligonucleotide
tgagagggatggccccca

SEQ ID NO: 1138 - DNA, 18 bp, Artificial sequence
  Synthetic oligonucleotide
cgcataacaccacgcccg

SEQ ID NO: 1139 - DNA, 18 bp, Artificial sequence
  Synthetic oligonucleotide
gccaaaatcaggaatggg

SEQ ID NO: 1140 - DNA, 18 bp, Artificial sequence
  Synthetic oligonucleotide
ggcagtccctgggttccg

SEQ ID NO: 1141 - DNA, 18 bp, Artificial sequence
  Synthetic oligonucleotide
gttgaacctgaccaagga

SEQ ID NO: 1142 - DNA, 18 bp, Artificial sequence
  Synthetic oligonucleotide
agcatgagttgtgccaag

SEQ ID NO: 1143 - DNA, 18 bp, Artificial sequence
  Synthetic oligonucleotide
cccactccgccaccttga

SEQ ID NO: 1144 - DNA, 18 bp, Artificial sequence
  Synthetic oligonucleotide
taccagagctgggtggtg

SEQ ID NO: 1145 - DNA, 18 bp, Artificial sequence
  Synthetic oligonucleotide
acatttgcctcagaaatc

SEQ ID NO: 1146 - DNA, 18 bp, Artificial sequence
  Synthetic oligonucleotide
gattcaggctgggagtgg

SEQ ID NO: 1147 - DNA, 18 bp, Artificial sequence
  Synthetic oligonucleotide
ctccgagagctgccactt

SEQ ID NO: 1148 - DNA, 18 bp, Artificial sequence
  Synthetic oligonucleotide
tgcagcagactcctaacg

SEQ ID NO: 1149 - DNA, 18 bp, Artificial sequence
  Synthetic oligonucleotide
aggaatctcacttttgtc

SEQ ID NO: 1150 - DNA, 18 bp, Artificial sequence
  Synthetic oligonucleotide
aggctgcccgtgccacca

SEQ ID NO: 1151 - DNA, 18 bp, Artificial sequence
  Synthetic oligonucleotide
ttagtgaatggccatcct

SEQ ID NO: 1152 - DNA, 18 bp, Artificial sequence
  Synthetic oligonucleotide
aaactgcttgaatttggg

SEQ ID NO: 1153 - DNA, 18 bp, Artificial sequence
  Synthetic oligonucleotide
tgtgagtcccctgtaatc

SEQ ID NO: 1154 - DNA, 18 bp, Artificial sequence
  Synthetic oligonucleotide
taaacagggccttaatga

SEQ ID NO: 1155 - DNA, 18 bp, Artificial sequence
  Synthetic oligonucleotide
tcctcccggctctagaaa

SEQ ID NO: 1156 - DNA, 18 bp, Artificial sequence
  Synthetic oligonucleotide
ggagacagccaggcatgg

SEQ ID NO: 1157 - DNA, 18 bp, Artificial sequence
  Synthetic oligonucleotide
ataatgttttttatagag

SEQ ID NO: 1158 - DNA, 18 bp, Artificial sequence
  Synthetic oligonucleotide
gactggatttttgtattt

SEQ ID NO: 1159 - DNA, 18 bp, Artificial sequence
  Synthetic oligonucleotide
cggagtcttattctgatg

SEQ ID NO: 1160 - DNA, 18 bp, Artificial sequence
  Synthetic oligonucleotide
ccgcagcaatgcccctgc

SEQ ID NO: 1161 - DNA, 18 bp, Artificial sequence
  Synthetic oligonucleotide
tctcgatccccttcaaga

SEQ ID NO: 1162 - DNA, 18 bp, Artificial sequence
  Synthetic oligonucleotide
ctgggtgtcctttaccct

SEQ ID NO: 1163 - DNA, 18 bp, Artificial sequence
  Synthetic oligonucleotide
cctgctccacgcctgcct

SEQ ID NO: 1164 - DNA, 18 bp, Artificial sequence
  Synthetic oligonucleotide
tcagggcctttatcctaa

SEQ ID NO: 1165 - DNA, 18 bp, Artificial sequence
  Synthetic oligonucleotide
tcggctccacagtctttg

SEQ ID NO: 1166 - DNA, 18 bp, Artificial sequence
  Synthetic oligonucleotide
caccactgggttaggcag

SEQ ID NO: 1167 - DNA, 18 bp, Artificial sequence
  Synthetic oligonucleotide
tcaccttcccgcctcccg

SEQ ID NO: 1168 - DNA, 18 bp, Artificial sequence
  Synthetic oligonucleotide
ttgaagagggtccagagg

SEQ ID NO: 1169 - DNA, 18 bp, Artificial sequence
  Synthetic oligonucleotide
tgcccagaaggcaggtgg

SEQ ID NO: 1170 - DNA, 18 bp, Artificial sequence
  Synthetic oligonucleotide
ggcccccgaagtctgtgc

SEQ ID NO: 1171 - DNA, 18 bp, Artificial sequence
  Synthetic oligonucleotide
cggtgcaggacagaggtg

SEQ ID NO: 1172 - DNA, 18 bp, Artificial sequence
  Synthetic oligonucleotide
cgcgcaccaccaccacgc

SEQ ID NO: 1173 - DNA, 18 bp, Artificial sequence
  Synthetic oligonucleotide
tcaggctgggccctaagc

SEQ ID NO: 1174 - DNA, 18 bp, Artificial sequence
  Synthetic oligonucleotide
tcacccttccccagctcc

SEQ ID NO: 1175 - DNA, 18 bp, Artificial sequence
  Synthetic oligonucleotide
tcagacccaagtgataag

SEQ ID NO: 1176 - DNA, 18 bp, Artificial sequence
  Synthetic oligonucleotide
gcagggtctacacatgcg

SEQ ID NO: 1177 - DNA, 18 bp, Artificial sequence
  Synthetic oligonucleotide
ctgagatgttctcttcct

SEQ ID NO: 1178 - DNA, 18 bp, Artificial sequence
  Synthetic oligonucleotide
agctgcggtacaggacag

SEQ ID NO: 1179 - DNA, 18 bp, Artificial sequence
  Synthetic oligonucleotide
ccagtgagggcccctctg

SEQ ID NO: 1180 - DNA, 18 bp, Artificial sequence
  Synthetic oligonucleotide
gcccccagaggtgcatgg

SEQ ID NO: 1181 - DNA, 18 bp, Artificial sequence
  Synthetic oligonucleotide
ggagcagcagacacatgc

SEQ ID NO: 1182 - DNA, 18 bp, Artificial sequence
  Synthetic oligonucleotide
ggaagctacttcccatgc

SEQ ID NO: 1183 - DNA, 18 bp, Artificial sequence
  Synthetic oligonucleotide
ggaggaggcctgacaccc

SEQ ID NO: 1184 - DNA, 18 bp, Artificial sequence
  Synthetic oligonucleotide
tttccctttggtgttagc

SEQ ID NO: 1185 - DNA, 18 bp, Artificial sequence
  Synthetic oligonucleotide
ccccaaagcaatctatgt

SEQ ID NO: 1186 - DNA, 18 bp, Artificial sequence
  Synthetic oligonucleotide
tctggagggaacactgcc

SEQ ID NO: 1187 - DNA, 18 bp, Artificial sequence
  Synthetic oligonucleotide
ggttgaggttgagggtag

SEQ ID NO: 1188 - DNA, 18 bp, Artificial sequence
  Synthetic oligonucleotide
actcccgcaggccaaaca

SEQ ID NO: 1189 - DNA, 18 bp, Artificial sequence
  Synthetic oligonucleotide
gagtgccaacaggcccag

SEQ ID NO: 1190 - DNA, 18 bp, Artificial sequence
  Synthetic oligonucleotide
ttctaagtacaatttggg

SEQ ID NO: 1191 - DNA, 18 bp, Artificial sequence
  Synthetic oligonucleotide
ttactggttgtgttttct

SEQ ID NO: 1192 - DNA, 18 bp, Artificial sequence
  Synthetic oligonucleotide
gagtctcagtctcactgt

SEQ ID NO: 1193 - DNA, 18 bp, Artificial sequence
  Synthetic oligonucleotide
cattcctcctgctgctgt

SEQ ID NO: 1194 - DNA, 18 bp, Artificial sequence
  Synthetic oligonucleotide
gctctgaagagctccacg

SEQ ID NO: 1195 - DNA, 18 bp, Artificial sequence
  Synthetic oligonucleotide
ctctcttcagggccaccg

SEQ ID NO: 1196 - DNA, 18 bp, Artificial sequence
  Synthetic oligonucleotide
ctctctcgccctgcatgg

SEQ ID NO: 1197 - DNA, 18 bp, Artificial sequence
  Synthetic oligonucleotide
ctggacatcctccgagaa

SEQ ID NO: 1198 - DNA, 18 bp, Artificial sequence
  Synthetic oligonucleotide
cacccaggctgcggccca

SEQ ID NO: 1199 - DNA, 18 bp, Artificial sequence
  Synthetic oligonucleotide
ctgtggtgcaagcctgtg

SEQ ID NO: 1200 - DNA, 18 bp, Artificial sequence
  Synthetic oligonucleotide
agacgagagtgcgcccac

SEQ ID NO: 1201 - DNA, 18 bp, Artificial sequence
  Synthetic oligonucleotide
ccacataaatgttctaca

SEQ ID NO: 1202 - DNA, 18 bp, Artificial sequence
  Synthetic oligonucleotide
ggtacaggaaaagatgcc

SEQ ID NO: 1203 - DNA, 18 bp, Artificial sequence
  Synthetic oligonucleotide
atcagcttaggaactgac

SEQ ID NO: 1204 - DNA, 18 bp, Artificial sequence
  Synthetic oligonucleotide
gtgcctcacagttggctc

SEQ ID NO: 1205 - DNA, 18 bp, Artificial sequence
  Synthetic oligonucleotide
gagaggctgtggtgaggt

SEQ ID NO: 1206 - DNA, 18 bp, Artificial sequence
  Synthetic oligonucleotide
gaaatcagaatcctgaaa

SEQ ID NO: 1207 - DNA, 18 bp, Artificial sequence
  Synthetic oligonucleotide
atgtggctttttcttgtt

SEQ ID NO: 1208 - DNA, 18 bp, Artificial sequence
  Synthetic oligonucleotide
gtttttttctggccgggc

SEQ ID NO: 1209 - DNA, 18 bp, Artificial sequence
  Synthetic oligonucleotide
ttttcagtggataaggct

SEQ ID NO: 1210 - DNA, 18 bp, Artificial sequence
  Synthetic oligonucleotide
acataaactccttctttg

SEQ ID NO: 1211 - DNA, 18 bp, Artificial sequence
  Synthetic oligonucleotide
tggtgaatgttgaaattc

SEQ ID NO: 1212 - DNA, 18 bp, Artificial sequence
  Synthetic oligonucleotide
aggacaaggaggccatgt

SEQ ID NO: 1213 - DNA, 18 bp, Artificial sequence
  Synthetic oligonucleotide
tcaaatgacagattctca

SEQ ID NO: 1214 - DNA, 18 bp, Artificial sequence
  Synthetic oligonucleotide
catccctactttctccct

SEQ ID NO: 1215 - DNA, 18 bp, Artificial sequence
  Synthetic oligonucleotide
tagaatcttgccttgtcg

SEQ ID NO: 1216 - DNA, 18 bp, Artificial sequence
  Synthetic oligonucleotide
gatacagacatacattgt

SEQ ID NO: 1217 - DNA, 18 bp, Artificial sequence
  Synthetic oligonucleotide
aattctttgtgatgatgg

SEQ ID NO: 1218 - DNA, 18 bp, Artificial sequence
  Synthetic oligonucleotide
gcacatatttacatttta

SEQ ID NO: 1219 - DNA, 18 bp, Artificial sequence
  Synthetic oligonucleotide
ggtgagagagccagcctc

SEQ ID NO: 1220 - DNA, 18 bp, Artificial sequence
  Synthetic oligonucleotide
caaacagcctcccatgaa

SEQ ID NO: 1221 - DNA, 18 bp, Artificial sequence
  Synthetic oligonucleotide
atatcctaagcattgtct

SEQ ID NO: 1222 - DNA, 18 bp, Artificial sequence
  Synthetic oligonucleotide
tacagtggctcctgtaat

SEQ ID NO: 1223 - DNA, 18 bp, Artificial sequence
  Synthetic oligonucleotide
gctcatcaaagcaaaaac

SEQ ID NO: 1224 - DNA, 18 bp, Artificial sequence
  Synthetic oligonucleotide
ctgggctgtcggatctgg

SEQ ID NO: 1225 - DNA, 18 bp, Artificial sequence
  Synthetic oligonucleotide
aagccaccatgcctgtaa

SEQ ID NO: 1226 - DNA, 18 bp, Artificial sequence
  Synthetic oligonucleotide
acaccatcacggctcagt

SEQ ID NO: 1227 - DNA, 18 bp, Artificial sequence
  Synthetic oligonucleotide
agggagttggaaaaactg

SEQ ID NO: 1228 - DNA, 18 bp, Artificial sequence
  Synthetic oligonucleotide
caggtttgagaagccctg

SEQ ID NO: 1229 - DNA, 18 bp, Artificial sequence
  Synthetic oligonucleotide
agacccaccggcacattc

SEQ ID NO: 1230 - DNA, 18 bp, Artificial sequence
  Synthetic oligonucleotide
atttccagcgggctttac

SEQ ID NO: 1231 - DNA, 18 bp, Artificial sequence
  Synthetic oligonucleotide
gcttgctcgcaaggacgc

SEQ ID NO: 1232 - DNA, 18 bp, Artificial sequence
  Synthetic oligonucleotide
ccacagcacggcgcatgg

SEQ ID NO: 1233 - DNA, 18 bp, Artificial sequence
  Synthetic oligonucleotide
acaccccctcctagaata

SEQ ID NO: 1234 - DNA, 18 bp, Artificial sequence
  Synthetic oligonucleotide
accaccttcagcccaact

SEQ ID NO: 1235 - DNA, 18 bp, Artificial sequence
  Synthetic oligonucleotide
taagctggaggcttagga

SEQ ID NO: 1236 - DNA, 18 bp, Artificial sequence
  Synthetic oligonucleotide
gaacctcccgccttagtc

SEQ ID NO: 1237 - DNA, 18 bp, Artificial sequence
  Synthetic oligonucleotide
tatatgattgttttttga

SEQ ID NO: 1238 - DNA, 18 bp, Artificial sequence
  Synthetic oligonucleotide
aggagcctcgggtgccca

SEQ ID NO: 1239 - DNA, 18 bp, Artificial sequence
  Synthetic oligonucleotide
tcaggccaggcattttct

SEQ ID NO: 1240 - DNA, 18 bp, Artificial sequence
  Synthetic oligonucleotide
cacttagcagacactggt

SEQ ID NO: 1241 - DNA, 18 bp, Artificial sequence
  Synthetic oligonucleotide
tcctctggccgagctcac

SEQ ID NO: 1242 - DNA, 18 bp, Artificial sequence
  Synthetic oligonucleotide
acagcgcgggacacacgg

SEQ ID NO: 1243 - DNA, 18 bp, Artificial sequence
  Synthetic oligonucleotide
gcatctcttctcaccagg

SEQ ID NO: 1244 - DNA, 18 bp, Artificial sequence
  Synthetic oligonucleotide
ggatacctggagggcagg

SEQ ID NO: 1245 - DNA, 18 bp, Artificial sequence
  Synthetic oligonucleotide
tgaggccagcactgaggg

SEQ ID NO: 1246 - DNA, 18 bp, Artificial sequence
  Synthetic oligonucleotide
actggaaccatcccgaat

SEQ ID NO: 1247 - DNA, 18 bp, Artificial sequence
  Synthetic oligonucleotide
gcagtggccttgtgtggg

SEQ ID NO: 1248 - DNA, 18 bp, Artificial sequence
  Synthetic oligonucleotide
accctgagctgccagctg

SEQ ID NO: 1249 - DNA, 18 bp, Artificial sequence
  Synthetic oligonucleotide
ctgcacactcagtgtcct

SEQ ID NO: 1250 - DNA, 18 bp, Artificial sequence
  Synthetic oligonucleotide
ctggaaaggcaggagtgg

SEQ ID NO: 1251 - DNA, 18 bp, Artificial sequence
  Synthetic oligonucleotide
aagagcctctgggaaaaa

SEQ ID NO: 1252 - DNA, 18 bp, Artificial sequence
  Synthetic oligonucleotide
ggtgtaactcaatgagaa

SEQ ID NO: 1253 - DNA, 18 bp, Artificial sequence
  Synthetic oligonucleotide
ggctacctggtttatgat

SEQ ID NO: 1254 - DNA, 18 bp, Artificial sequence
  Synthetic oligonucleotide
ggagcgagctggagccac

SEQ ID NO: 1255 - DNA, 18 bp, Artificial sequence
  Synthetic oligonucleotide
gctcactccgctcactgc

SEQ ID NO: 1256 - DNA, 18 bp, Artificial sequence
  Synthetic oligonucleotide
ctaggtcttattctattt

SEQ ID NO: 1257 - DNA, 18 bp, Artificial sequence
  Synthetic oligonucleotide
aggtttttgttgtgtgtt

SEQ ID NO: 1258 - DNA, 18 bp, Artificial sequence
  Synthetic oligonucleotide
cctcttcaccttaaaaaa

SEQ ID NO: 1259 - DNA, 18 bp, Artificial sequence
  Synthetic oligonucleotide
aaacaaagtcacagaggg

SEQ ID NO: 1260 - DNA, 18 bp, Artificial sequence
  Synthetic oligonucleotide
aggatcactttcttttct

SEQ ID NO: 1261 - DNA, 18 bp, Artificial sequence
  Synthetic oligonucleotide
ttgctgagtctcactctg

SEQ ID NO: 1262 - DNA, 18 bp, Artificial sequence
  Synthetic oligonucleotide
cagaatctatagctgtgt

SEQ ID NO: 1263 - DNA, 18 bp, Artificial sequence
  Synthetic oligonucleotide
atactttccacagggaga

SEQ ID NO: 1264 - DNA, 18 bp, Artificial sequence
  Synthetic oligonucleotide
gaagaagggtccctctct

SEQ ID NO: 1265 - DNA, 18 bp, Artificial sequence
  Synthetic oligonucleotide
atgagagtacaactccat

SEQ ID NO: 1266 - DNA, 18 bp, Artificial sequence
  Synthetic oligonucleotide
accctttcaggccgggcg

SEQ ID NO: 1267 - DNA, 18 bp, Artificial sequence
  Synthetic oligonucleotide
taagtaaagtctgttttt

SEQ ID NO: 1268 - DNA, 18 bp, Artificial sequence
  Synthetic oligonucleotide
tagaatggtgtttggata

SEQ ID NO: 1269 - DNA, 18 bp, Artificial sequence
  Synthetic oligonucleotide
gcagtctacagggcaaag

SEQ ID NO: 1270 - DNA, 18 bp, Artificial sequence
  Synthetic oligonucleotide
acctttttatttcctccg

SEQ ID NO: 1271 - DNA, 18 bp, Artificial sequence
  Synthetic oligonucleotide
agctccaggtgattgaga

SEQ ID NO: 1272 - DNA, 18 bp, Artificial sequence
  Synthetic oligonucleotide
gtcgccatgtaagaaatg

SEQ ID NO: 1273 - DNA, 18 bp, Artificial sequence
  Synthetic oligonucleotide
agggagactgatatggtt

SEQ ID NO: 1274 - DNA, 18 bp, Artificial sequence
  Synthetic oligonucleotide
atattgcttgacctcagg

SEQ ID NO: 1275 - DNA, 18 bp, Artificial sequence
  Synthetic oligonucleotide
agtggttctcgctttttt

SEQ ID NO: 1276 - DNA, 18 bp, Artificial sequence
  Synthetic oligonucleotide
caagacaggcaggcagag

SEQ ID NO: 1277 - DNA, 18 bp, Artificial sequence
  Synthetic oligonucleotide
gtgcttggctgcgcttct

SEQ ID NO: 1278 - DNA, 18 bp, Artificial sequence
  Synthetic oligonucleotide
cagacctctatcttttag

SEQ ID NO: 1279 - DNA, 18 bp, Artificial sequence
  Synthetic oligonucleotide
aggagggtctttcccgtg

SEQ ID NO: 1280 - DNA, 18 bp, Artificial sequence
  Synthetic oligonucleotide
aactgggccaccatgaga

SEQ ID NO: 1281 - DNA, 18 bp, Artificial sequence
  Synthetic oligonucleotide
cctgccgctcggccgtcc

SEQ ID NO: 1282 - DNA, 18 bp, Artificial sequence
  Synthetic oligonucleotide
cgccctgccgctcggccg

SEQ ID NO: 1283 - DNA, 18 bp, Artificial sequence
  Synthetic oligonucleotide
gtgggcgcgcgcgagcgc

SEQ ID NO: 1284 - DNA, 18 bp, Artificial sequence
  Synthetic oligonucleotide
ctagtgggcgcgcgcgag

SEQ ID NO: 1285 - DNA, 18 bp, Artificial sequence
  Synthetic oligonucleotide
ccactagtgggcgcgcgc

SEQ ID NO: 1286 - DNA, 18 bp, Artificial sequence
  Synthetic oligonucleotide
cggccactagtgggcgcg

SEQ ID NO: 1287 - DNA, 18 bp, Artificial sequence
  Synthetic oligonucleotide
ctccggccactagtgggc

SEQ ID NO: 1288 - DNA, 18 bp, Artificial sequence
  Synthetic oligonucleotide
ctcctccggccactagtg

SEQ ID NO: 1289 - DNA, 18 bp, Artificial sequence
  Synthetic oligonucleotide
cttctcctccggccacta

SEQ ID NO: 1290 - DNA, 18 bp, Artificial sequence
  Synthetic oligonucleotide
agccttctcctccggcca

SEQ ID NO: 1291 - DNA, 18 bp, Artificial sequence
  Synthetic oligonucleotide
gggagccttctcctccgg

SEQ ID NO: 1292 - DNA, 18 bp, Artificial sequence
  Synthetic oligonucleotide
cgcgggagccttctcctc

SEQ ID NO: 1293 - DNA, 18 bp, Artificial sequence
  Synthetic oligonucleotide
ctccgcgggagccttctc

SEQ ID NO: 1294 - DNA, 18 bp, Artificial sequence
  Synthetic oligonucleotide
ggcctccgcgggagcctt

SEQ ID NO: 1295 - DNA, 18 bp, Artificial sequence
  Synthetic oligonucleotide
cgcggcctccgcgggagc

SEQ ID NO: 1296 - DNA, 18 bp, Artificial sequence
  Synthetic oligonucleotide
cagcgcggcctccgcggg

SEQ ID NO: 1297 - DNA, 18 bp, Artificial sequence
  Synthetic oligonucleotide
gggcagcgcggcctccgc

SEQ ID NO: 1298 - DNA, 18 bp, Artificial sequence
  Synthetic oligonucleotide
ggcgggcagcgcggcctc

SEQ ID NO: 1299 - DNA, 18 bp, Artificial sequence
  Synthetic oligonucleotide
acgcgagcctccccaggg

SEQ ID NO: 1300 - DNA, 18 bp, Artificial sequence
  Synthetic oligonucleotide
ggaacgcgagcctcccca

SEQ ID NO: 1301 - DNA, 18 bp, Artificial sequence
  Synthetic oligonucleotide
gcgggaacgcgagcctcc

SEQ ID NO: 1302 - DNA, 18 bp, Artificial sequence
  Synthetic oligonucleotide
gcagcgggaacgcgagcc

SEQ ID NO: 1303 - DNA, 18 bp, Artificial sequence
  Synthetic oligonucleotide
cgagcagcgggaacgcga

SEQ ID NO: 1304 - DNA, 18 bp, Artificial sequence
  Synthetic oligonucleotide
gcgcgagcagcgggaacg

SEQ ID NO: 1305 - DNA, 18 bp, Artificial sequence
  Synthetic oligonucleotide
caggcgcgagcagcggga

SEQ ID NO: 1306 - DNA, 18 bp, Artificial sequence
  Synthetic oligonucleotide
gcgcaggcgcgagcagcg

SEQ ID NO: 1307 - DNA, 18 bp, Artificial sequence
  Synthetic oligonucleotide
gcggcgcaggcgcgagca

SEQ ID NO: 1308 - DNA, 18 bp, Artificial sequence
  Synthetic oligonucleotide
cgggcggcgcaggcgcga

SEQ ID NO: 1309 - DNA, 18 bp, Artificial sequence
  Synthetic oligonucleotide
cggcgggcggcgcaggcg

SEQ ID NO: 1310 - DNA, 18 bp, Artificial sequence
  Synthetic oligonucleotide
ggccggcgggcggcgcag

SEQ ID NO: 1311 - DNA, 18 bp, Artificial sequence
  Synthetic oligonucleotide
tgaggccggcgggcggcg

SEQ ID NO: 1312 - DNA, 18 bp, Artificial sequence
  Synthetic oligonucleotide
tcctgaggccggcgggcg

SEQ ID NO: 1313 - DNA, 18 bp, Artificial sequence
  Synthetic oligonucleotide
cgttcctgaggccggcgg

SEQ ID NO: 1314 - DNA, 18 bp, Artificial sequence
  Synthetic oligonucleotide
gccggcgaagagggcgcg

SEQ ID NO: 1315 - DNA, 18 bp, Artificial sequence
  Synthetic oligonucleotide
cgcgccggcgaagagggc

SEQ ID NO: 1316 - DNA, 18 bp, Artificial sequence
  Synthetic oligonucleotide
gcgcgcgccggcgaagag

SEQ ID NO: 1317 - DNA, 18 bp, Artificial sequence
  Synthetic oligonucleotide
agggcgcgcgccggcgaa

SEQ ID NO: 1318 - DNA, 18 bp, Artificial sequence
  Synthetic oligonucleotide
gcgagggcgcgcgccggc

SEQ ID NO: 1319 - DNA, 18 bp, Artificial sequence
  Synthetic oligonucleotide
actgcgagggcgcgcgcc

SEQ ID NO: 1320 - DNA, 18 bp, Artificial sequence
  Synthetic oligonucleotide
gtgactgcgagggcgcgc

SEQ ID NO: 1321 - DNA, 18 bp, Artificial sequence
  Synthetic oligonucleotide
gcggtgactgcgagggcg

SEQ ID NO: 1322 - DNA, 18 bp, Artificial sequence
  Synthetic oligonucleotide
gtggcggtgactgcgagg

SEQ ID NO: 1323 - DNA, 18 bp, Artificial sequence
  Synthetic oligonucleotide
tgggtggcggtgactgcg

SEQ ID NO: 1324 - DNA, 18 bp, Artificial sequence
  Synthetic oligonucleotide
tggtgggtggcggtgact

SEQ ID NO: 1325 - DNA, 18 bp, Artificial sequence
  Synthetic oligonucleotide
agctggtgggtggcggtg

SEQ ID NO: 1326 - DNA, 18 bp, Artificial sequence
  Synthetic oligonucleotide
cggagctggtgggtggcg

SEQ ID NO: 1327 - DNA, 18 bp, Artificial sequence
  Synthetic oligonucleotide
tgccggagctggtgggtg

SEQ ID NO: 1328 - DNA, 18 bp, Artificial sequence
  Synthetic oligonucleotide
tggtgccggagctggtgg

SEQ ID NO: 1329 - DNA, 18 bp, Artificial sequence
  Synthetic oligonucleotide
tgttggtgccggagctgg

SEQ ID NO: 1330 - DNA, 18 bp, Artificial sequence
  Synthetic oligonucleotide
tgctgttggtgccggagc

SEQ ID NO: 1331 - DNA, 18 bp, Artificial sequence
  Synthetic oligonucleotide
cgctgctgttggtgccgg

SEQ ID NO: 1332 - DNA, 18 bp, Artificial sequence
  Synthetic oligonucleotide
gggcggtggcagcggcgc

SEQ ID NO: 1333 - DNA, 18 bp, Artificial sequence
  Synthetic oligonucleotide
ggtgggcggtggcagcgg

SEQ ID NO: 1334 - DNA, 18 bp, Artificial sequence
  Synthetic oligonucleotide
gaaggtgggcggtggcag

SEQ ID NO: 1335 - DNA, 18 bp, Artificial sequence
  Synthetic oligonucleotide
gcagaaggtgggcggtgg

SEQ ID NO: 1336 - DNA, 18 bp, Artificial sequence
  Synthetic oligonucleotide
gcggcagaaggtgggcgg

SEQ ID NO: 1337 - DNA, 18 bp, Artificial sequence
  Synthetic oligonucleotide
gcggcggcagaaggtggg

SEQ ID NO: 1338 - DNA, 18 bp, Artificial sequence
  Synthetic oligonucleotide
gtggcggcggcagaaggt

SEQ ID NO: 1339 - DNA, 18 bp, Artificial sequence
  Synthetic oligonucleotide
gtggtggcggcggcagaa

SEQ ID NO: 1340 - DNA, 18 bp, Artificial sequence
  Synthetic oligonucleotide
gctgtggtggcggcggca

SEQ ID NO: 1341 - DNA, 18 bp, Artificial sequence
  Synthetic oligonucleotide
gtggctgtggtggcggcg

SEQ ID NO: 1342 - DNA, 18 bp, Artificial sequence
  Synthetic oligonucleotide
aaggtggctgtggtggcg

SEQ ID NO: 1343 - DNA, 18 bp, Artificial sequence
  Synthetic oligonucleotide
aaacccttctcacaaaac

SEQ ID NO: 1344 - DNA, 18 bp, Artificial sequence
  Synthetic oligonucleotide
cctcctggtccctcctcg

SEQ ID NO: 1345 - DNA, 18 bp, Artificial sequence
  Synthetic oligonucleotide
cctatccagacccactca

SEQ ID NO: 1346 - DNA, 18 bp, Artificial sequence
  Synthetic oligonucleotide
cacaaccaccccgggacg

SEQ ID NO: 1347 - DNA, 18 bp, Artificial sequence
  Synthetic oligonucleotide
ggaccaggatggtgtttt

SEQ ID NO: 1348 - DNA, 18 bp, Artificial sequence
  Synthetic oligonucleotide
ggctttgataaaaatatt

SEQ ID NO: 1349 - DNA, 18 bp, Artificial sequence
  Synthetic oligonucleotide
cgcctccgggatcaagca

SEQ ID NO: 1350 - DNA, 18 bp, Artificial sequence
  Synthetic oligonucleotide
ggttcgcatttaagctag

SEQ ID NO: 1351 - DNA, 18 bp, Artificial sequence
  Synthetic oligonucleotide
acggtcattctcagccct

SEQ ID NO: 1352 - DNA, 18 bp, Artificial sequence
  Synthetic oligonucleotide
taacctccagagcaactg

SEQ ID NO: 1353 - DNA, 18 bp, Artificial sequence
  Synthetic oligonucleotide
ggcaggtgggccacaaaa

SEQ ID NO: 1354 - DNA, 18 bp, Artificial sequence
  Synthetic oligonucleotide
tcaaaaggcatgcacatt

SEQ ID NO: 1355 - DNA, 18 bp, Artificial sequence
  Synthetic oligonucleotide
tagtattccgtcgccacg

SEQ ID NO: 1356 - DNA, 18 bp, Artificial sequence
  Synthetic oligonucleotide
gagctgttgtttttattg

SEQ ID NO: 1357 - DNA, 18 bp, Artificial sequence
  Synthetic oligonucleotide
gccagggactgttttttg

SEQ ID NO: 1358 - DNA, 18 bp, Artificial sequence
  Synthetic oligonucleotide
tcacctgatagtcgacag

SEQ ID NO: 1359 - DNA, 18 bp, Artificial sequence
  Synthetic oligonucleotide
agttcacctgatagtcga

SEQ ID NO: 1360 - DNA, 18 bp, Artificial sequence
  Synthetic oligonucleotide
caaagttcacctgatagt

SEQ ID NO: 1361 - DNA, 18 bp, Artificial sequence
  Synthetic oligonucleotide
gttcaaagttcacctgat

SEQ ID NO: 1362 - DNA, 18 bp, Artificial sequence
  Synthetic oligonucleotide
gattctttcaggccagcg

SEQ ID NO: 1363 - DNA, 18 bp, Artificial sequence
  Synthetic oligonucleotide
ggagattctttcaggcca

SEQ ID NO: 1364 - DNA, 18 bp, Artificial sequence
  Synthetic oligonucleotide
atcttccgctgttggagt

SEQ ID NO: 1365 - DNA, 18 bp, Artificial sequence
  Synthetic oligonucleotide
cacatcttccgctgttgg

SEQ ID NO: 1366 - DNA, 18 bp, Artificial sequence
  Synthetic oligonucleotide
tgtcacatcttccgctgt

SEQ ID NO: 1367 - DNA, 18 bp, Artificial sequence
  Synthetic oligonucleotide
tgctgtcacatcttccgc

SEQ ID NO: 1368 - DNA, 18 bp, Artificial sequence
  Synthetic oligonucleotide
agggtgctgtcacatctt

SEQ ID NO: 1369 - DNA, 18 bp, Artificial sequence
  Synthetic oligonucleotide
gagaaggtggctgtggtg

SEQ ID NO: 1370 - DNA, 18 bp, Artificial sequence
  Synthetic oligonucleotide
gaggagaaggtggctgtg

SEQ ID NO: 1371 - DNA, 18 bp, Artificial sequence
  Synthetic oligonucleotide
gcggaggaggagaaggtg

SEQ ID NO: 1372 - DNA, 18 bp, Artificial sequence
  Synthetic oligonucleotide
acagcggaggaggagaag

SEQ ID NO: 1373 - DNA, 18 bp, Artificial sequence
  Synthetic oligonucleotide
aggacagcggaggaggag

SEQ ID NO: 1374 - DNA, 18 bp, Artificial sequence
  Synthetic oligonucleotide
gagaggacagcggaggag

SEQ ID NO: 1375 - DNA, 18 bp, Artificial sequence
  Synthetic oligonucleotide
cgggagaggacagcggag

SEQ ID NO: 1376 - DNA, 18 bp, Artificial sequence
  Synthetic oligonucleotide
ggacgggagaggacagcg

SEQ ID NO: 1377 - DNA, 18 bp, Artificial sequence
  Synthetic oligonucleotide
cgaggacgggagaggaca

SEQ ID NO: 1378 - DNA, 18 bp, Artificial sequence
  Synthetic oligonucleotide
aggcgaggacgggagagg

SEQ ID NO: 1379 - DNA, 18 bp, Artificial sequence
  Synthetic oligonucleotide
cagaggcgaggacgggag

SEQ ID NO: 1380 - DNA, 18 bp, Artificial sequence
  Synthetic oligonucleotide
cgacagaggcgaggacgg

SEQ ID NO: 1381 - DNA, 18 bp, Artificial sequence
  Synthetic oligonucleotide
agtcgacagaggcgagga

SEQ ID NO: 1382 - DNA, 18 bp, Artificial sequence
  Synthetic oligonucleotide
gatagtcgacagaggcga

SEQ ID NO: 1383 - DNA, 18 bp, Artificial sequence
  Synthetic oligonucleotide
cctgatagtcgacagagg

SEQ ID NO: 1384 - DNA, 18 bp, Artificial sequence
  Synthetic oligonucleotide
ctggttcaaagttcacct

SEQ ID NO: 1385 - DNA, 18 bp, Artificial sequence
  Synthetic oligonucleotide
atcctggttcaaagttca

SEQ ID NO: 1386 - DNA, 18 bp, Artificial sequence
  Synthetic oligonucleotide
gccatcctggttcaaagt

SEQ ID NO: 1387 - DNA, 18 bp, Artificial sequence
  Synthetic oligonucleotide
tcagccatcctggttcaa

SEQ ID NO: 1388 - DNA, 18 bp, Artificial sequence
  Synthetic oligonucleotide
ggctcagccatcctggtt

SEQ ID NO: 1389 - DNA, 18 bp, Artificial sequence
  Synthetic oligonucleotide
cttcgaactcctggcggg

SEQ ID NO: 1390 - DNA, 18 bp, Artificial sequence
  Synthetic oligonucleotide
tcacttcgaactcctggc

SEQ ID NO: 1391 - DNA, 18 bp, Artificial sequence
  Synthetic oligonucleotide
ccatcacttcgaactcct

SEQ ID NO: 1392 - DNA, 18 bp, Artificial sequence
  Synthetic oligonucleotide
cttccatcacttcgaact

SEQ ID NO: 1393 - DNA, 18 bp, Artificial sequence
  Synthetic oligonucleotide
gatcttccatcacttcga

SEQ ID NO: 1394 - DNA, 18 bp, Artificial sequence
  Synthetic oligonucleotide
cgtgatcttccatcactt

SEQ ID NO: 1395 - DNA, 18 bp, Artificial sequence
  Synthetic oligonucleotide
tgtcccccaacccgtacg

SEQ ID NO: 1396 - DNA, 18 bp, Artificial sequence
  Synthetic oligonucleotide
tcctgtcccccaacccgt

SEQ ID NO: 1397 - DNA, 18 bp, Artificial sequence
  Synthetic oligonucleotide
ctttcctgtcccccaacc

SEQ ID NO: 1398 - DNA, 18 bp, Artificial sequence
  Synthetic oligonucleotide
gatctttcctgtccccca

SEQ ID NO: 1399 - DNA, 18 bp, Artificial sequence
  Synthetic oligonucleotide
cctgatctttcctgtccc

SEQ ID NO: 1400 - DNA, 18 bp, Artificial sequence
  Synthetic oligonucleotide
ccccctgatctttcctgt

SEQ ID NO: 1401 - DNA, 18 bp, Artificial sequence
  Synthetic oligonucleotide
agcccccctgatctttcc

SEQ ID NO: 1402 - DNA, 18 bp, Artificial sequence
  Synthetic oligonucleotide
tgtagcccccctgatctt

SEQ ID NO: 1403 - DNA, 18 bp, Artificial sequence
  Synthetic oligonucleotide
tggtgtagcccccctgat

SEQ ID NO: 1404 - DNA, 18 bp, Artificial sequence
  Synthetic oligonucleotide
gcatggtgtagcccccct

SEQ ID NO: 1405 - DNA, 18 bp, Artificial sequence
  Synthetic oligonucleotide
ggtgcatggtgtagcccc

SEQ ID NO: 1406 - DNA, 18 bp, Artificial sequence
  Synthetic oligonucleotide
cttggtgcatggtgtagc

SEQ ID NO: 1407 - DNA, 18 bp, Artificial sequence
  Synthetic oligonucleotide
ggtcttggtgcatggtgt

SEQ ID NO: 1408 - DNA, 18 bp, Artificial sequence
  Synthetic oligonucleotide
cttggtcttggtgcatgg

SEQ ID NO: 1409 - DNA, 18 bp, Artificial sequence
  Synthetic oligonucleotide
cctcttggtcttggtgca

SEQ ID NO: 1410 - DNA, 18 bp, Artificial sequence
  Synthetic oligonucleotide
caccctcttggtcttggt

SEQ ID NO: 1411 - DNA, 18 bp, Artificial sequence
  Synthetic oligonucleotide
cgtgtcaccctcttggtc

SEQ ID NO: 1412 - DNA, 18 bp, Artificial sequence
  Synthetic oligonucleotide
gtccgtgtcaccctcttg

SEQ ID NO: 1413 - DNA, 18 bp, Artificial sequence
  Synthetic oligonucleotide
agatccgtcctcagtggg

SEQ ID NO: 1414 - DNA, 18 bp, Artificial sequence
  Synthetic oligonucleotide
ctcagatccgtcctcagt

SEQ ID NO: 1415 - DNA, 18 bp, Artificial sequence
  Synthetic oligonucleotide
ttcctcagatccgtcctc

SEQ ID NO: 1416 - DNA, 18 bp, Artificial sequence
  Synthetic oligonucleotide
cggttcctcagatccgtc

SEQ ID NO: 1417 - DNA, 18 bp, Artificial sequence
  Synthetic oligonucleotide
gcccggttcctcagatcc

SEQ ID NO: 1418 - DNA, 18 bp, Artificial sequence
  Synthetic oligonucleotide
agagcccggttcctcaga

SEQ ID NO: 1419 - DNA, 18 bp, Artificial sequence
  Synthetic oligonucleotide
ttcagagcccggttcctc

SEQ ID NO: 1420 - DNA, 18 bp, Artificial sequence
  Synthetic oligonucleotide
ggtttcagagcccggttc

SEQ ID NO: 1421 - DNA, 18 bp, Artificial sequence
  Synthetic oligonucleotide
agaggtttcagagcccgg

SEQ ID NO: 1422 - DNA, 18 bp, Artificial sequence
  Synthetic oligonucleotide
atcagaggtttcagagcc

SEQ ID NO: 1423 - DNA, 18 bp, Artificial sequence
  Synthetic oligonucleotide
agcatcagaggtttcaga

SEQ ID NO: 1424 - DNA, 18 bp, Artificial sequence
  Synthetic oligonucleotide
cttagcatcagaggtttc

SEQ ID NO: 1425 - DNA, 18 bp, Artificial sequence
  Synthetic oligonucleotide
gctcttagcatcagaggt

SEQ ID NO: 1426 - DNA, 18 bp, Artificial sequence
  Synthetic oligonucleotide
agtgctcttagcatcaga

SEQ ID NO: 1427 - DNA, 18 bp, Artificial sequence
  Synthetic oligonucleotide
tggagtgctcttagcatc

SEQ ID NO: 1428 - DNA, 18 bp, Artificial sequence
  Synthetic oligonucleotide
tgttggagtgctcttagc

SEQ ID NO: 1429 - DNA, 18 bp, Artificial sequence
  Synthetic oligonucleotide
cgctgttggagtgctctt

SEQ ID NO: 1430 - DNA, 18 bp, Artificial sequence
  Synthetic oligonucleotide
ttccgctgttggagtgct

SEQ ID NO: 1431 - DNA, 18 bp, Artificial sequence
  Synthetic oligonucleotide
ctaagggtgctgtcacat

SEQ ID NO: 1432 - DNA, 18 bp, Artificial sequence
  Synthetic oligonucleotide
ccactaagggtgctgtca

SEQ ID NO: 1433 - DNA, 18 bp, Artificial sequence
  Synthetic oligonucleotide
catccactaagggtgctg

SEQ ID NO: 1434 - DNA, 18 bp, Artificial sequence
  Synthetic oligonucleotide
cctcatccactaagggtg

SEQ ID NO: 1435 - DNA, 18 bp, Artificial sequence
  Synthetic oligonucleotide
gctgtggttccttctggg

SEQ ID NO: 1436 - DNA, 18 bp, Artificial sequence
  Synthetic oligonucleotide
tcaggctcttgggtcacg

SEQ ID NO: 1437 - DNA, 18 bp, Artificial sequence
  Synthetic oligonucleotide
ctttcaggctcttgggtc

SEQ ID NO: 1438 - DNA, 18 bp, Artificial sequence
  Synthetic oligonucleotide
ccactttcaggctcttgg

SEQ ID NO: 1439 - DNA, 18 bp, Artificial sequence
  Synthetic oligonucleotide
ctccctcatccactaagg

SEQ ID NO: 1440 - DNA, 18 bp, Artificial sequence
  Synthetic oligonucleotide
gagctccctcatccacta

SEQ ID NO: 1441 - DNA, 18 bp, Artificial sequence
  Synthetic oligonucleotide
cgggagctccctcatcca

SEQ ID NO: 1442 - DNA, 18 bp, Artificial sequence
  Synthetic oligonucleotide
tgccgggagctccctcat

SEQ ID NO: 1443 - DNA, 18 bp, Artificial sequence
  Synthetic oligonucleotide
gcttgccgggagctccct

SEQ ID NO: 1444 - DNA, 18 bp, Artificial sequence
  Synthetic oligonucleotide
cctgcttgccgggagctc

SEQ ID NO: 1445 - DNA, 18 bp, Artificial sequence
  Synthetic oligonucleotide
cagcctgcttgccgggag

SEQ ID NO: 1446 - DNA, 18 bp, Artificial sequence
  Synthetic oligonucleotide
cggcagcctgcttgccgg

SEQ ID NO: 1447 - DNA, 18 bp, Artificial sequence
  Synthetic oligonucleotide
gcgcggcagcctgcttgc

SEQ ID NO: 1448 - DNA, 18 bp, Artificial sequence
  Synthetic oligonucleotide
gctgcgcggcagcctgct

SEQ ID NO: 1449 - DNA, 18 bp, Artificial sequence
  Synthetic oligonucleotide
tctgggatctccgtgtgg

SEQ ID NO: 1450 - DNA, 18 bp, Artificial sequence
  Synthetic oligonucleotide
ccttctgggatctccgtg

SEQ ID NO: 1451 - DNA, 18 bp, Artificial sequence
  Synthetic oligonucleotide
gttccttctgggatctcc

SEQ ID NO: 1452 - DNA, 18 bp, Artificial sequence
  Synthetic oligonucleotide
gtggttccttctgggatc

SEQ ID NO: 1453 - DNA, 18 bp, Artificial sequence
  Synthetic oligonucleotide
caatgcctgcttcttcag

SEQ ID NO: 1454 - DNA, 18 bp, Artificial sequence
  Synthetic oligonucleotide
gtctccaatgcctgcttc

SEQ ID NO: 1455 - DNA, 18 bp, Artificial sequence
  Synthetic oligonucleotide
ggtgtctccaatgcctgc

SEQ ID NO: 1456 - DNA, 18 bp, Artificial sequence
  Synthetic oligonucleotide
ttaccactttcaggctct

SEQ ID NO: 1457 - DNA, 18 bp, Artificial sequence
  Synthetic oligonucleotide
ccaccttaccactttcag

SEQ ID NO: 1458 - DNA, 18 bp, Artificial sequence
  Synthetic oligonucleotide
ggaccaccttaccacttt

SEQ ID NO: 1459 - DNA, 18 bp, Artificial sequence
  Synthetic oligonucleotide
cctggaccaccttaccac

SEQ ID NO: 1460 - DNA, 18 bp, Artificial sequence
  Synthetic oligonucleotide
cttcctggaccaccttac

SEQ ID NO: 1461 - DNA, 18 bp, Artificial sequence
  Synthetic oligonucleotide
agccttcctggaccacct

SEQ ID NO: 1462 - DNA, 18 bp, Artificial sequence
  Synthetic oligonucleotide
ggaagccttcctggacca

SEQ ID NO: 1463 - DNA, 18 bp, Artificial sequence
  Synthetic oligonucleotide
ggaggaagccttcctgga

SEQ ID NO: 1464 - DNA, 18 bp, Artificial sequence
  Synthetic oligonucleotide
ctcggaggaagccttcct

SEQ ID NO: 1465 - DNA, 18 bp, Artificial sequence
  Synthetic oligonucleotide
gctctcggaggaagcctt

SEQ ID NO: 1466 - DNA, 18 bp, Artificial sequence
  Synthetic oligonucleotide
ctggctctcggaggaagc

SEQ ID NO: 1467 - DNA, 18 bp, Artificial sequence
  Synthetic oligonucleotide
ggcctggctctcggagga

SEQ ID NO: 1468 - DNA, 18 bp, Artificial sequence
  Synthetic oligonucleotide
tggtggctcagacctggg

SEQ ID NO: 1469 - DNA, 18 bp, Artificial sequence
  Synthetic oligonucleotide
agctggtggctcagacct

SEQ ID NO: 1470 - DNA, 18 bp, Artificial sequence
  Synthetic oligonucleotide
atgagctggtggctcaga

SEQ ID NO: 1471 - DNA, 18 bp, Artificial sequence
  Synthetic oligonucleotide
gacatgagctggtggctc

SEQ ID NO: 1472 - DNA, 18 bp, Artificial sequence
  Synthetic oligonucleotide
ccggacatgagctggtgg

SEQ ID NO: 1473 - DNA, 18 bp, Artificial sequence
  Synthetic oligonucleotide
atgccggacatgagctgg

SEQ ID NO: 1474 - DNA, 18 bp, Artificial sequence
  Synthetic oligonucleotide
ggcatgccggacatgagc

SEQ ID NO: 1475 - DNA, 18 bp, Artificial sequence
  Synthetic oligonucleotide
ccaggcatgccggacatg

SEQ ID NO: 1476 - DNA, 18 bp, Artificial sequence
  Synthetic oligonucleotide
gccccaggcatgccggac

SEQ ID NO: 1477 - DNA, 18 bp, Artificial sequence
  Synthetic oligonucleotide
ggagccccaggcatgccg

SEQ ID NO: 1478 - DNA, 18 bp, Artificial sequence
  Synthetic oligonucleotide
ggccctcaggcaggaggg

SEQ ID NO: 1479 - DNA, 18 bp, Artificial sequence
  Synthetic oligonucleotide
tgtccccgaaggttggcg

SEQ ID NO: 1480 - DNA, 18 bp, Artificial sequence
  Synthetic oligonucleotide
tcctgtccccgaaggttg

SEQ ID NO: 1481 - DNA, 18 bp, Artificial sequence
  Synthetic oligonucleotide
aggtcctgtccccgaagg

SEQ ID NO: 1482 - DNA, 18 bp, Artificial sequence
  Synthetic oligonucleotide
ctcaggtcctgtccccga

SEQ ID NO: 1483 - DNA, 18 bp, Artificial sequence
  Synthetic oligonucleotide
gtcctcaggtcctgtccc

SEQ ID NO: 1484 - DNA, 18 bp, Artificial sequence
  Synthetic oligonucleotide
tgtgtcctcaggtcctgt

SEQ ID NO: 1485 - DNA, 18 bp, Artificial sequence
  Synthetic oligonucleotide
ctctgtgtcctcaggtcc

SEQ ID NO: 1486 - DNA, 18 bp, Artificial sequence
  Synthetic oligonucleotide
gccctctgtgtcctcagg

SEQ ID NO: 1487 - DNA, 18 bp, Artificial sequence
  Synthetic oligonucleotide
gccgccctctgtgtcctc

SEQ ID NO: 1488 - DNA, 18 bp, Artificial sequence
  Synthetic oligonucleotide
gcggccgccctctgtgtc

SEQ ID NO: 1489 - DNA, 18 bp, Artificial sequence
  Synthetic oligonucleotide
gtggcggccgccctctgt

SEQ ID NO: 1490 - DNA, 18 bp, Artificial sequence
  Synthetic oligonucleotide
tgcttgagcagctcaggg

SEQ ID NO: 1491 - DNA, 18 bp, Artificial sequence
  Synthetic oligonucleotide
tggtgcttgagcagctca

SEQ ID NO: 1492 - DNA, 18 bp, Artificial sequence
  Synthetic oligonucleotide
aagctggtgcttgagcag

SEQ ID NO: 1493 - DNA, 18 bp, Artificial sequence
  Synthetic oligonucleotide
tagaagctggtgcttgag

SEQ ID NO: 1494 - DNA, 18 bp, Artificial sequence
  Synthetic oligonucleotide
tcctagaagctggtgctt

SEQ ID NO: 1495 - DNA, 18 bp, Artificial sequence
  Synthetic oligonucleotide
gtctcctagaagctggtg

SEQ ID NO: 1496 - DNA, 18 bp, Artificial sequence
  Synthetic oligonucleotide
caggtctcctagaagctg

SEQ ID NO: 1497 - DNA, 18 bp, Artificial sequence
  Synthetic oligonucleotide
gtgcaggtctcctagaag

SEQ ID NO: 1498 - DNA, 18 bp, Artificial sequence
  Synthetic oligonucleotide
ctggtgcaggtctcctag

SEQ ID NO: 1499 - DNA, 18 bp, Artificial sequence
  Synthetic oligonucleotide
ctcctggtgcaggtctcc

SEQ ID NO: 1500 - DNA, 18 bp, Artificial sequence
  Synthetic oligonucleotide
cccctcctggtgcaggtc

SEQ ID NO: 1501 - DNA, 18 bp, Artificial sequence
  Synthetic oligonucleotide
cggcccctcctggtgcag

SEQ ID NO: 1502 - DNA, 18 bp, Artificial sequence
  Synthetic oligonucleotide
cggcggcccctcctggtg

SEQ ID NO: 1503 - DNA, 18 bp, Artificial sequence
  Synthetic oligonucleotide
cagcggcggcccctcctg

SEQ ID NO: 1504 - DNA, 18 bp, Artificial sequence
  Synthetic oligonucleotide
cttcagcggcggcccctc

SEQ ID NO: 1505 - DNA, 18 bp, Artificial sequence
  Synthetic oligonucleotide
ccccttcagcggcggccc

SEQ ID NO: 1506 - DNA, 18 bp, Artificial sequence
  Synthetic oligonucleotide
tgcccccttcagcggcgg

SEQ ID NO: 1507 - DNA, 18 bp, Artificial sequence
  Synthetic oligonucleotide
ccctgcccccttcagcgg

SEQ ID NO: 1508 - DNA, 18 bp, Artificial sequence
  Synthetic oligonucleotide
gccccctgcccccttcag

SEQ ID NO: 1509 - DNA, 18 bp, Artificial sequence
  Synthetic oligonucleotide
tttgccccctgccccctt

SEQ ID NO: 1510 - DNA, 18 bp, Artificial sequence
  Synthetic oligonucleotide
ctctttgccccctgcccc

SEQ ID NO: 1511 - DNA, 18 bp, Artificial sequence
  Synthetic oligonucleotide
cctctctttgccccctgc

SEQ ID NO: 1512 - DNA, 18 bp, Artificial sequence
  Synthetic oligonucleotide
cggcctctctttgccccc

SEQ ID NO: 1513 - DNA, 18 bp, Artificial sequence
  Synthetic oligonucleotide
ccccggcctctctttgcc

SEQ ID NO: 1514 - DNA, 18 bp, Artificial sequence
  Synthetic oligonucleotide
gctccccggcctctcttt

SEQ ID NO: 1515 - DNA, 18 bp, Artificial sequence
  Synthetic oligonucleotide
cttgctccccggcctctc

SEQ ID NO: 1516 - DNA, 18 bp, Artificial sequence
  Synthetic oligonucleotide
ctccttgctccccggcct

SEQ ID NO: 1517 - DNA, 18 bp, Artificial sequence
  Synthetic oligonucleotide
ctcctccttgctccccgg

SEQ ID NO: 1518 - DNA, 18 bp, Artificial sequence
  Synthetic oligonucleotide
cacctcctccttgctccc

SEQ ID NO: 1519 - DNA, 18 bp, Artificial sequence
  Synthetic oligonucleotide
atccacctcctccttgct

SEQ ID NO: 1520 - DNA, 18 bp, Artificial sequence
  Synthetic oligonucleotide
cttcatccacctcctcct

SEQ ID NO: 1521 - DNA, 18 bp, Artificial sequence
  Synthetic oligonucleotide
ggtcttcatccacctcct

SEQ ID NO: 1522 - DNA, 18 bp, Artificial sequence
  Synthetic oligonucleotide
cgcggtcttcatccacct

SEQ ID NO: 1523 - DNA, 18 bp, Artificial sequence
  Synthetic oligonucleotide
cgtcgcggtcttcatcca

SEQ ID NO: 1524 - DNA, 18 bp, Artificial sequence
  Synthetic oligonucleotide
ccgcccatcttgggctgg

SEQ ID NO: 1525 - DNA, 18 bp, Artificial sequence
  Synthetic oligonucleotide
aggccgcccatcttgggc

SEQ ID NO: 1526 - DNA, 18 bp, Artificial sequence
  Synthetic oligonucleotide
gggaggccgcccatcttg

SEQ ID NO: 1527 - DNA, 18 bp, Artificial sequence
  Synthetic oligonucleotide
ctctggcggctgtctggg

SEQ ID NO: 1528 - DNA, 18 bp, Artificial sequence
  Synthetic oligonucleotide
cttctctggcggctgtct

SEQ ID NO: 1529 - DNA, 18 bp, Artificial sequence
  Synthetic oligonucleotide
tggcttctctggcggctg

SEQ ID NO: 1530 - DNA, 18 bp, Artificial sequence
  Synthetic oligonucleotide
tggtggcttctctggcgg

SEQ ID NO: 1531 - DNA, 18 bp, Artificial sequence
  Synthetic oligonucleotide
tgctggtggcttctctgg

SEQ ID NO: 1532 - DNA, 18 bp, Artificial sequence
  Synthetic oligonucleotide
ggatgctggtggcttctc

SEQ ID NO: 1533 - DNA, 18 bp, Artificial sequence
  Synthetic oligonucleotide
ctgggatgctggtggctt

SEQ ID NO: 1534 - DNA, 18 bp, Artificial sequence
  Synthetic oligonucleotide
agcctgggatgctggtgg

SEQ ID NO: 1535 - DNA, 18 bp, Artificial sequence
  Synthetic oligonucleotide
ggaagcctgggatgctgg

SEQ ID NO: 1536 - DNA, 18 bp, Artificial sequence
  Synthetic oligonucleotide
ctccgctgggaagcctgg

SEQ ID NO: 1537 - DNA, 18 bp, Artificial sequence
  Synthetic oligonucleotide
accctccgctgggaagcc

SEQ ID NO: 1538 - DNA, 18 bp, Artificial sequence
  Synthetic oligonucleotide
ggcaccctccgctgggaa

SEQ ID NO: 1539 - DNA, 18 bp, Artificial sequence
  Synthetic oligonucleotide
gatggcaccctccgctgg

SEQ ID NO: 1540 - DNA, 18 bp, Artificial sequence
  Synthetic oligonucleotide
aggaaatccacagggagg

SEQ ID NO: 1541 - DNA, 18 bp, Artificial sequence
  Synthetic oligonucleotide
gagaggaaatccacaggg

SEQ ID NO: 1542 - DNA, 18 bp, Artificial sequence
  Synthetic oligonucleotide
ttggagaggaaatccaca

SEQ ID NO: 1543 - DNA, 18 bp, Artificial sequence
  Synthetic oligonucleotide
actttggagaggaaatcc

SEQ ID NO: 1544 - DNA, 18 bp, Artificial sequence
  Synthetic oligonucleotide
ggaaactttggagaggaa

SEQ ID NO: 1545 - DNA, 18 bp, Artificial sequence
  Synthetic oligonucleotide
tgtggaaactttggagag

SEQ ID NO: 1546 - DNA, 18 bp, Artificial sequence
  Synthetic oligonucleotide
ctctgtggaaactttgga

SEQ ID NO: 1547 - DNA, 18 bp, Artificial sequence
  Synthetic oligonucleotide
gatctctgtggaaacttt

SEQ ID NO: 1548 - DNA, 18 bp, Artificial sequence
  Synthetic oligonucleotide
tgggatctctgtggaaac

SEQ ID NO: 1549 - DNA, 18 bp, Artificial sequence
  Synthetic oligonucleotide
ggctgggatctctgtgga

SEQ ID NO: 1550 - DNA, 18 bp, Artificial sequence
  Synthetic oligonucleotide
tgaggctgggatctctgt

SEQ ID NO: 1551 - DNA, 18 bp, Artificial sequence
  Synthetic oligonucleotide
ctctgaggctgggatctc

SEQ ID NO: 1552 - DNA, 18 bp, Artificial sequence
  Synthetic oligonucleotide
gtcgggctctgaggctgg

SEQ ID NO: 1553 - DNA, 18 bp, Artificial sequence
  Synthetic oligonucleotide
cccgtcgggctctgaggc

SEQ ID NO: 1554 - DNA, 18 bp, Artificial sequence
  Synthetic oligonucleotide
ctacactgggcccgtcgg

SEQ ID NO: 1555 - DNA, 18 bp, Artificial sequence
  Synthetic oligonucleotide
gccctacactgggcccgt

SEQ ID NO: 1556 - DNA, 18 bp, Artificial sequence
  Synthetic oligonucleotide
cccgccctacactgggcc

SEQ ID NO: 1557 - DNA, 18 bp, Artificial sequence
  Synthetic oligonucleotide
tggcccgccctacactgg

SEQ ID NO: 1558 - DNA, 18 bp, Artificial sequence
  Synthetic oligonucleotide
ctttggcccgccctacac

SEQ ID NO: 1559 - DNA, 18 bp, Artificial sequence
  Synthetic oligonucleotide
gccctttggcccgcccta

SEQ ID NO: 1560 - DNA, 18 bp, Artificial sequence
  Synthetic oligonucleotide
cctgccctttggcccgcc

SEQ ID NO: 1561 - DNA, 18 bp, Artificial sequence
  Synthetic oligonucleotide
catcctgccctttggccc

SEQ ID NO: 1562 - DNA, 18 bp, Artificial sequence
  Synthetic oligonucleotide
gggcatcctgccctttgg

SEQ ID NO: 1563 - DNA, 18 bp, Artificial sequence
  Synthetic oligonucleotide
ttgggtgtgatttccacg

SEQ ID NO: 1564 - DNA, 18 bp, Artificial sequence
  Synthetic oligonucleotide
gcctgctccttctgcacg

SEQ ID NO: 1565 - DNA, 18 bp, Artificial sequence
  Synthetic oligonucleotide
tgcgcctgctccttctgc

SEQ ID NO: 1566 - DNA, 18 bp, Artificial sequence
  Synthetic oligonucleotide
gagtgcgcctgctccttc

SEQ ID NO: 1567 - DNA, 18 bp, Artificial sequence
  Synthetic oligonucleotide
tccgagtgcgcctgctcc

SEQ ID NO: 1568 - DNA, 18 bp, Artificial sequence
  Synthetic oligonucleotide
tcctccgagtgcgcctgc

SEQ ID NO: 1569 - DNA, 18 bp, Artificial sequence
  Synthetic oligonucleotide
tgctcctccgagtgcgcc

SEQ ID NO: 1570 - DNA, 18 bp, Artificial sequence
  Synthetic oligonucleotide
aaatgctcctccgagtgc

SEQ ID NO: 1571 - DNA, 18 bp, Artificial sequence
  Synthetic oligonucleotide
cccaaatgctcctccgag

SEQ ID NO: 1572 - DNA, 18 bp, Artificial sequence
  Synthetic oligonucleotide
cttcccaaatgctcctcc

SEQ ID NO: 1573 - DNA, 18 bp, Artificial sequence
  Synthetic oligonucleotide
gcccttcccaaatgctcc

SEQ ID NO: 1574 - DNA, 18 bp, Artificial sequence
  Synthetic oligonucleotide
gcagcccttcccaaatgc

SEQ ID NO: 1575 - DNA, 18 bp, Artificial sequence
  Synthetic oligonucleotide
aatgcagcccttcccaaa

SEQ ID NO: 1576 - DNA, 18 bp, Artificial sequence
  Synthetic oligonucleotide
ctggaaatgcagcccttc

SEQ ID NO: 1577 - DNA, 18 bp, Artificial sequence
  Synthetic oligonucleotide
cccctggaaatgcagccc

SEQ ID NO: 1578 - DNA, 18 bp, Artificial sequence
  Synthetic oligonucleotide
gggcccctggaaatgcag

SEQ ID NO: 1579 - DNA, 18 bp, Artificial sequence
  Synthetic oligonucleotide
tctggcccctctccaggg

SEQ ID NO: 1580 - DNA, 18 bp, Artificial sequence
  Synthetic oligonucleotide
gcctctggcccctctcca

SEQ ID NO: 1581 - DNA, 18 bp, Artificial sequence
  Synthetic oligonucleotide
cgggcctctggcccctct

SEQ ID NO: 1582 - DNA, 18 bp, Artificial sequence
  Synthetic oligonucleotide
ccccgggcctctggcccc

SEQ ID NO: 1583 - DNA, 18 bp, Artificial sequence
  Synthetic oligonucleotide
gtcctctcccaaagaggg

SEQ ID NO: 1584 - DNA, 18 bp, Artificial sequence
  Synthetic oligonucleotide
tgtgtcctctcccaaaga

SEQ ID NO: 1585 - DNA, 18 bp, Artificial sequence
  Synthetic oligonucleotide
ttttgtgtcctctcccaa

SEQ ID NO: 1586 - DNA, 18 bp, Artificial sequence
  Synthetic oligonucleotide
ctctggaaggtcagcctc

SEQ ID NO: 1587 - DNA, 18 bp, Artificial sequence
  Synthetic oligonucleotide
gggctctggaaggtcagc

SEQ ID NO: 1588 - DNA, 18 bp, Artificial sequence
  Synthetic oligonucleotide
agagggctctggaaggtc

SEQ ID NO: 1589 - DNA, 18 bp, Artificial sequence
  Synthetic oligonucleotide
cctccacccagcatggtg

SEQ ID NO: 1590 - DNA, 18 bp, Artificial sequence
  Synthetic oligonucleotide
tcaagtcaccctttctcc

SEQ ID NO: 1591 - DNA, 18 bp, Artificial sequence
  Synthetic oligonucleotide
ttcagacaatttttctag

SEQ ID NO: 1592 - DNA, 18 bp, Artificial sequence
  Synthetic oligonucleotide
tcagactccgccagcttt

SEQ ID NO: 1593 - DNA, 18 bp, Artificial sequence
  Synthetic oligonucleotide
tcttttccctttggtgtt

SEQ ID NO: 1594 - DNA, 18 bp, Artificial sequence
  Synthetic oligonucleotide
tttcccccaatgatttgc

SEQ ID NO: 1595 - DNA, 18 bp, Artificial sequence
  Synthetic oligonucleotide
ccacgactcccacaagat

SEQ ID NO: 1596 - DNA, 18 bp, Artificial sequence
  Synthetic oligonucleotide
tgaggttgagggtaggtg

SEQ ID NO: 1597 - DNA, 18 bp, Artificial sequence
  Synthetic oligonucleotide
agtggttgaggttgaggg

SEQ ID NO: 1598 - DNA, 18 bp, Artificial sequence
  Synthetic oligonucleotide
caggcacttggaaactgc

SEQ ID NO: 1599 - DNA, 18 bp, Artificial sequence
  Synthetic oligonucleotide
ttgtactctttttcccct

SEQ ID NO: 1600 - DNA, 18 bp, Artificial sequence
  Synthetic oligonucleotide
ttaggagtgcaaggttgt

SEQ ID NO: 1601 - DNA, 18 bp, Artificial sequence
  Synthetic oligonucleotide
tcctacattcctcctgct

SEQ ID NO: 1602 - DNA, 18 bp, Artificial sequence
  Synthetic oligonucleotide
gttgcagtgttccactat

SEQ ID NO: 1603 - DNA, 18 bp, Artificial sequence
  Synthetic oligonucleotide
ccagcagatgccgacagc

SEQ ID NO: 1604 - DNA, 18 bp, Artificial sequence
  Synthetic oligonucleotide
gggccctcacccctgctt

SEQ ID NO: 1605 - DNA, 18 bp, Artificial sequence
  Synthetic oligonucleotide
ccaagaagggctgctgag

SEQ ID NO: 1606 - DNA, 18 bp, Artificial sequence
  Synthetic oligonucleotide
aagcagccacccaggctg

SEQ ID NO: 1607 - DNA, 18 bp, Artificial sequence
  Synthetic oligonucleotide
tatgaggagggaggaaag

SEQ ID NO: 1608 - DNA, 18 bp, Artificial sequence
  Synthetic oligonucleotide
ctgacatctcagcccaag

SEQ ID NO: 1609 - DNA, 18 bp, Artificial sequence
  Synthetic oligonucleotide
caaggtgatcagcttagg

SEQ ID NO: 1610 - DNA, 18 bp, Artificial sequence
  Synthetic oligonucleotide
agtccaaggtgatcagct

SEQ ID NO: 1611 - DNA, 18 bp, Artificial sequence
  Synthetic oligonucleotide
cccacacaagcctcctct

SEQ ID NO: 1612 - DNA, 18 bp, Artificial sequence
  Synthetic oligonucleotide
tttgtttgggttcagttc

SEQ ID NO: 1613 - DNA, 18 bp, Artificial sequence
  Synthetic oligonucleotide
ccttgatctggttttgtt

SEQ ID NO: 1614 - DNA, 18 bp, Artificial sequence
  Synthetic oligonucleotide
atcaagggagagaacgat

SEQ ID NO: 1615 - DNA, 18 bp, Artificial sequence
  Synthetic oligonucleotide
aaaaggcaacaagccttt

SEQ ID NO: 1616 - DNA, 18 bp, Artificial sequence
  Synthetic oligonucleotide
cgaggcaaaaagggaaat

SEQ ID NO: 1617 - DNA, 18 bp, Artificial sequence
  Synthetic oligonucleotide
taactttgagcttcctgg

SEQ ID NO: 1618 - DNA, 18 bp, Artificial sequence
  Synthetic oligonucleotide
taaggcttagaagatttg

SEQ ID NO: 1619 - DNA, 18 bp, Artificial sequence
  Synthetic oligonucleotide
gacgatcattttttattc

SEQ ID NO: 1620 - DNA, 18 bp, Artificial sequence
  Synthetic oligonucleotide
ggcttgacgatcattttt

SEQ ID NO: 1621 - DNA, 18 bp, Artificial sequence
  Synthetic oligonucleotide
agatctcagagtttgtag

SEQ ID NO: 1622 - DNA, 18 bp, Artificial sequence
  Synthetic oligonucleotide
tcgctgaggttccgcaac

SEQ ID NO: 1623 - DNA, 18 bp, Artificial sequence
  Synthetic oligonucleotide
aggaggccatgtgaggct

SEQ ID NO: 1624 - DNA, 18 bp, Artificial sequence
  Synthetic oligonucleotide
tggataaatctctagtgc

SEQ ID NO: 1625 - DNA, 18 bp, Artificial sequence
  Synthetic oligonucleotide
cactcctcctttagagat

SEQ ID NO: 1626 - DNA, 18 bp, Artificial sequence
  Synthetic oligonucleotide
ttgtaattccttctctgg

SEQ ID NO: 1627 - DNA, 18 bp, Artificial sequence
  Synthetic oligonucleotide
taaccatccctactttct

SEQ ID NO: 1628 - DNA, 18 bp, Artificial sequence
  Synthetic oligonucleotide
actgaaatcgctccttta

SEQ ID NO: 1629 - DNA, 18 bp, Artificial sequence
  Synthetic oligonucleotide
ccaattatgactgaaatc

SEQ ID NO: 1630 - DNA, 18 bp, Artificial sequence
  Synthetic oligonucleotide
ggtcaaagttataaatat

SEQ ID NO: 1631 - DNA, 18 bp, Artificial sequence
  Synthetic oligonucleotide
ggatttgatgcaaagaaa

SEQ ID NO: 1632 - DNA, 18 bp, Artificial sequence
  Synthetic oligonucleotide
gcgcaacccagctactcg

SEQ ID NO: 1633 - DNA, 18 bp, Artificial sequence
  Synthetic oligonucleotide
ctgtatacctatacttgg

SEQ ID NO: 1634 - DNA, 18 bp, Artificial sequence
  Synthetic oligonucleotide
ccgttttcttaccaccct

SEQ ID NO: 1635 - DNA, 18 bp, Artificial sequence
  Synthetic oligonucleotide
ttacttgtctgaatcttc

SEQ ID NO: 1636 - DNA, 18 bp, Artificial sequence
  Synthetic oligonucleotide
ttcatcccgttttttttc

SEQ ID NO: 1637 - DNA, 18 bp, Artificial sequence
  Synthetic oligonucleotide
gacctcagtggctctttt

SEQ ID NO: 1638 - DNA, 18 bp, Artificial sequence
  Synthetic oligonucleotide
tgtccaggatagtttgaa

SEQ ID NO: 1639 - DNA, 18 bp, Artificial sequence
  Synthetic oligonucleotide
gctgagcaaatgctcccg

SEQ ID NO: 1640 - DNA, 18 bp, Artificial sequence
  Synthetic oligonucleotide
ctgaccccgtaggcagga

SEQ ID NO: 1641 - DNA, 18 bp, Artificial sequence
  Synthetic oligonucleotide
accagcctgaggtcaagt

SEQ ID NO: 1642 - DNA, 18 bp, Artificial sequence
  Synthetic oligonucleotide
caggtcctcacttcacaa

SEQ ID NO: 1643 - DNA, 18 bp, Artificial sequence
  Synthetic oligonucleotide
ccgcctgcttgctcgcaa

SEQ ID NO: 1644 - DNA, 18 bp, Artificial sequence
  Synthetic oligonucleotide
agtgacacgccaccctgg

SEQ ID NO: 1645 - DNA, 18 bp, Artificial sequence
  Synthetic oligonucleotide
aaaaaggatgagtgacac

SEQ ID NO: 1646 - DNA, 18 bp, Artificial sequence
  Synthetic oligonucleotide
ggtagccagaaaaaagga

SEQ ID NO: 1647 - DNA, 18 bp, Artificial sequence
  Synthetic oligonucleotide
cctttggtagccagaaaa

SEQ ID NO: 1648 - DNA, 18 bp, Artificial sequence
  Synthetic oligonucleotide
ctgcacctttggtagcca

SEQ ID NO: 1649 - DNA, 18 bp, Artificial sequence
  Synthetic oligonucleotide
attatctgcacctttggt

SEQ ID NO: 1650 - DNA, 18 bp, Artificial sequence
  Synthetic oligonucleotide
taattatctgcacctttg

SEQ ID NO: 1651 - DNA, 18 bp, Artificial sequence
  Synthetic oligonucleotide
cactgccgcctcccggga

SEQ ID NO: 1652 - DNA, 18 bp, Artificial sequence
  Synthetic oligonucleotide
ctcacactgccgcctccc

SEQ ID NO: 1653 - DNA, 18 bp, Artificial sequence
  Synthetic oligonucleotide
tactcacactgccgcctc

SEQ ID NO: 1654 - DNA, 18 bp, Artificial sequence
  Synthetic oligonucleotide
ggtactcacactgccgcc

SEQ ID NO: 1655 - DNA, 18 bp, Artificial sequence
  Synthetic oligonucleotide
aaggtactcacactgccg

SEQ ID NO: 1656 - DNA, 18 bp, Artificial sequence
  Synthetic oligonucleotide
gtgtgaaggtactcacac

SEQ ID NO: 1657 - DNA, 18 bp, Artificial sequence
  Synthetic oligonucleotide
gccacagcacggcgcatg

SEQ ID NO: 1658 - DNA, 18 bp, Artificial sequence
  Synthetic oligonucleotide
aataattcaagccacagc

SEQ ID NO: 1659 - DNA, 18 bp, Artificial sequence
  Synthetic oligonucleotide
accacttcctaataattc

SEQ ID NO: 1660 - DNA, 18 bp, Artificial sequence
  Synthetic oligonucleotide
acgcactcacaccacttc

SEQ ID NO: 1661 - DNA, 18 bp, Artificial sequence
  Synthetic oligonucleotide
tcgcaagtgtacgcactc

SEQ ID NO: 1662 - DNA, 18 bp, Artificial sequence
  Synthetic oligonucleotide
atgcagtgtctcgcaagt

SEQ ID NO: 1663 - DNA, 18 bp, Artificial sequence
  Synthetic oligonucleotide
tgatgggtattctcagct

SEQ ID NO: 1664 - DNA, 18 bp, Artificial sequence
  Synthetic oligonucleotide
ccgctcggccgtccggcg

SEQ ID NO: 1665 - DNA, 18 bp, Artificial sequence
  Synthetic oligonucleotide
ctgccgctcggccgtccg

SEQ ID NO: 1666 - DNA, 18 bp, Artificial sequence
  Synthetic oligonucleotide
ccagagctgggtggtgtc

SEQ ID NO: 1667 - DNA, 18 bp, Artificial sequence
  Synthetic oligonucleotide
tgtagactatttgcacct

SEQ ID NO: 1668 - DNA, 18 bp, Artificial sequence
  Synthetic oligonucleotide
atcactgattttgaagtc

SEQ ID NO: 1669 - DNA, 18 bp, Artificial sequence
  Synthetic oligonucleotide
cccatcactgattttgaa

SEQ ID NO: 1670 - DNA, 18 bp, Artificial sequence
  Synthetic oligonucleotide
actcccatcactgatttt

SEQ ID NO: 1671 - DNA, 18 bp, Artificial sequence
  Synthetic oligonucleotide
cttactcccatcactgat

SEQ ID NO: 1672 - DNA, 18 bp, Artificial sequence
  Synthetic oligonucleotide
gctcttactcccatcact

SEQ ID NO: 1673 - DNA, 18 bp, Artificial sequence
  Synthetic oligonucleotide
tttgctcttactcccatc

SEQ ID NO: 1674 - DNA, 18 bp, Artificial sequence
  Synthetic oligonucleotide
aaatttgctcttactccc

SEQ ID NO: 1675 - DNA, 18 bp, Artificial sequence
  Synthetic oligonucleotide
atgaaatttgctcttact

SEQ ID NO: 1676 - DNA, 18 bp, Artificial sequence
  Synthetic oligonucleotide
aagatgaaatttgctctt

SEQ ID NO: 1677 - DNA, 18 bp, Artificial sequence
  Synthetic oligonucleotide
ggaaagatgaaatttgct

SEQ ID NO: 1678 - DNA, 18 bp, Artificial sequence
  Synthetic oligonucleotide
tttggaaagatgaaattt

SEQ ID NO: 1679 - DNA, 18 bp, Artificial sequence
  Synthetic oligonucleotide
catcaatttggaaagatg

SEQ ID NO: 1680 - DNA, 18 bp, Artificial sequence
  Synthetic oligonucleotide
acccatcaatttggaaag

SEQ ID NO: 1681 - DNA, 18 bp, Artificial sequence
  Synthetic oligonucleotide
cccacccatcaatttgga

SEQ ID NO: 1682 - DNA, 18 bp, Artificial sequence
  Synthetic oligonucleotide
tagcccacccatcaattt

SEQ ID NO: 1683 - DNA, 18 bp, Artificial sequence
  Synthetic oligonucleotide
tactagcccacccatcaa

SEQ ID NO: 1684 - DNA, 18 bp, Artificial sequence
  Synthetic oligonucleotide
tattactagcccacccat

SEQ ID NO: 1685 - DNA, 18 bp, Artificial sequence
  Synthetic oligonucleotide
ttttattactagcccacc

SEQ ID NO: 1686 - DNA, 18 bp, Artificial sequence
  Synthetic oligonucleotide
atattttattactagccc

SEQ ID NO: 1687 - DNA, 18 bp, Artificial sequence
  Synthetic oligonucleotide
taaatattttattactag

SEQ ID NO: 1688 - DNA, 18 bp, Artificial sequence
  Synthetic oligonucleotide
ttttaaatattttattac

SEQ ID NO: 1689 - DNA, 18 bp, Artificial sequence
  Synthetic oligonucleotide
atgtttttttttaaatat

SEQ ID NO: 1690 - DNA, 18 bp, Artificial sequence
  Synthetic oligonucleotide
gccatgtttttgaatgtt

SEQ ID NO: 1691 - DNA, 18 bp, Artificial sequence
  Synthetic oligonucleotide
gtggccatgtttttgaat

SEQ ID NO: 1692 - DNA, 18 bp, Artificial sequence
  Synthetic oligonucleotide
gatgtggccatgtttttg

SEQ ID NO: 1693 - DNA, 18 bp, Artificial sequence
  Synthetic oligonucleotide
ttggatgtggccatgttt

SEQ ID NO: 1694 - DNA, 18 bp, Artificial sequence
  Synthetic oligonucleotide
atgttggatgtggccatg

SEQ ID NO: 1695 - DNA, 18 bp, Artificial sequence
  Synthetic oligonucleotide
gaaatgttggatgtggcc

SEQ ID NO: 1696 - DNA, 18 bp, Artificial sequence
  Synthetic oligonucleotide
gaggaaatgttggatgtg

SEQ ID NO: 1697 - DNA, 18 bp, Artificial sequence
  Synthetic oligonucleotide
cctgaggaaatgttggat

SEQ ID NO: 1698 - DNA, 18 bp, Artificial sequence
  Synthetic oligonucleotide
ttgcctgaggaaatgttg

SEQ ID NO: 1699 - DNA, 18 bp, Artificial sequence
  Synthetic oligonucleotide
ccaaattcacttttacag

SEQ ID NO: 1700 - DNA, 18 bp, Artificial sequence
  Synthetic oligonucleotide
ttccaaattcacttttac

SEQ ID NO: 1701 - DNA, 18 bp, Artificial sequence
  Synthetic oligonucleotide
atttccaaattcactttt

SEQ ID NO: 1702 - DNA, 18 bp, Artificial sequence
  Synthetic oligonucleotide
ttatttccaaattcactt

SEQ ID NO: 1703 - DNA, 18 bp, Artificial sequence
  Synthetic oligonucleotide
ctttatttccaaattcac

SEQ ID NO: 1704 - DNA, 18 bp, Artificial sequence
  Synthetic oligonucleotide
aactttatttccaaattc

SEQ ID NO: 1705 - DNA, 18 bp, Artificial sequence
  Synthetic oligonucleotide
ataactttatttccaaat

SEQ ID NO: 1706 - DNA, 18 bp, Artificial sequence
  Synthetic oligonucleotide
gtaataactttatttcca

SEQ ID NO: 1707 - DNA, 18 bp, Artificial sequence
  Synthetic oligonucleotide
gagtaataactttatttc

SEQ ID NO: 1708 - DNA, 18 bp, Artificial sequence
  Synthetic oligonucleotide
cagagtaataactttatt

SEQ ID NO: 1709 - DNA, 18 bp, Artificial sequence
  Synthetic oligonucleotide
atcagagtaataacttta

SEQ ID NO: 1710 - DNA, 18 bp, Artificial sequence
  Synthetic oligonucleotide
taatcagagtaataactt

SEQ ID NO: 1711 - DNA, 18 bp, Artificial sequence
  Synthetic oligonucleotide
tttaatcagagtaataac

SEQ ID NO: 1712 - DNA, 18 bp, Artificial sequence
  Synthetic oligonucleotide
gcttccgctgttggagtg

SEQ ID NO: 1713 - DNA, 18 bp, Artificial sequence
  Synthetic oligonucleotide
tcagcttccgctgttgga

SEQ ID NO: 1714 - DNA, 18 bp, Artificial sequence
  Synthetic oligonucleotide
tcttcagcttccgctgtt

SEQ ID NO: 1715 - DNA, 18 bp, Artificial sequence
  Synthetic oligonucleotide
gcttcttcagcttccgct

SEQ ID NO: 1716 - DNA, 18 bp, Artificial sequence
  Synthetic oligonucleotide
gcccccttggcttttttg

SEQ ID NO: 1717 - DNA, 18 bp, Artificial sequence
  Synthetic oligonucleotide
tcagcccccttggctttt

SEQ ID NO: 1718 - DNA, 18 bp, Artificial sequence
  Synthetic oligonucleotide
accatcagcccccttggc

SEQ ID NO: 1719 - DNA, 18 bp, Artificial sequence
  Synthetic oligonucleotide
tcaccagagctgggtggt

SEQ ID NO: 1720 - DNA, 18 bp, Artificial sequence
  Synthetic oligonucleotide
ggttcaccagagctgggt

SEQ ID NO: 1721 - DNA, 18 bp, Artificial sequence
  Synthetic oligonucleotide
ggaggttcaccagagctg

SEQ ID NO: 1722 - DNA, 18 bp, Artificial sequence
  Synthetic oligonucleotide
tttggaggttcaccagag

SEQ ID NO: 1723 - DNA, 18 bp, Artificial sequence
  Synthetic oligonucleotide
gattttggaggttcacca

SEQ ID NO: 1724 - DNA, 18 bp, Artificial sequence
  Synthetic oligonucleotide
ttgcaccttcccgcctcc

SEQ ID NO: 1725 - DNA, 18 bp, Artificial sequence
  Synthetic oligonucleotide
agactatttgcaccttcc

SEQ ID NO: 1726 - DNA, 18 bp, Artificial sequence
  Synthetic oligonucleotide
cccttcgcggtcccttcg

SEQ ID NO: 1727 - DNA, 18 bp, Artificial sequence
  Synthetic oligonucleotide
ctgcccttcgcggtccct

SEQ ID NO: 1728 - DNA, 18 bp, Artificial sequence
  Synthetic oligonucleotide
gcgctgcccttcgcggtc

SEQ ID NO: 1729 - DNA, 18 bp, Artificial sequence
  Synthetic oligonucleotide
gtcccccaaacccgtacg

SEQ ID NO: 1730 - DNA, 18 bp, Artificial sequence
  Synthetic oligonucleotide
cctgtcccccaaacccgt

SEQ ID NO: 1731 - DNA, 18 bp, Artificial sequence
  Synthetic oligonucleotide
tttcctgtcccccaaacc

SEQ ID NO: 1732 - DNA, 18 bp, Artificial sequence
  Synthetic oligonucleotide
ttgatctttcctgtcccc

SEQ ID NO: 1733 - DNA, 18 bp, Artificial sequence
  Synthetic oligonucleotide
cccttgatctttcctgtc

SEQ ID NO: 1734 - DNA, 18 bp, Artificial sequence
  Synthetic oligonucleotide
gcccccttgatctttcct

SEQ ID NO: 1735 - DNA, 18 bp, Artificial sequence
  Synthetic oligonucleotide
gtagcccccttgatcttt

SEQ ID NO: 1736 - DNA, 18 bp, Artificial sequence
  Synthetic oligonucleotide
ggtgtagcccccttgatc

SEQ ID NO: 1737 - DNA, 18 bp, Artificial sequence
  Synthetic oligonucleotide
catggtgtagcccccttg

SEQ ID NO: 1738 - DNA, 18 bp, Artificial sequence
  Synthetic oligonucleotide
atgcgagcttgggtcacg

SEQ ID NO: 1739 - DNA, 18 bp, Artificial sequence
  Synthetic oligonucleotide
accatgcgagcttgggtc

SEQ ID NO: 1740 - DNA, 18 bp, Artificial sequence
  Synthetic oligonucleotide
ctgaccatgcgagcttgg

SEQ ID NO: 1741 - DNA, 18 bp, Artificial sequence
  Synthetic oligonucleotide
gagctttgagttgaggga

SEQ ID NO: 1742 - DNA, 18 bp, Artificial sequence
  Synthetic oligonucleotide
tgcgagctttgagttgag

SEQ ID NO: 1743 - DNA, 18 bp, Artificial sequence
  Synthetic oligonucleotide
ccatgcgagctttgagtt

SEQ ID NO: 1744 - DNA, 18 bp, Artificial sequence
  Synthetic oligonucleotide
tgaccatgcgagctttga

SEQ ID NO: 1745 - DNA, 18 bp, Artificial sequence
  Synthetic oligonucleotide
tactgaccatgcgagctt

SEQ ID NO: 1746 - DNA, 18 bp, Artificial sequence
  Synthetic oligonucleotide
gatgtcttggcttttttg

SEQ ID NO: 1747 - DNA, 18 bp, Artificial sequence
  Synthetic oligonucleotide
gtgtggatgtcttggctt

SEQ ID NO: 1748 - DNA, 18 bp, Artificial sequence
  Synthetic oligonucleotide
ttcagagggctctggaag

SEQ ID NO: 1749 - DNA, 18 bp, Artificial sequence
  Synthetic oligonucleotide
cttttcagagggctctgg

SEQ ID NO: 1750 - DNA, 18 bp, Artificial sequence
  Synthetic oligonucleotide
ctgcttttcagagggctc

SEQ ID NO: 1751 - DNA, 18 bp, Artificial sequence
  Synthetic oligonucleotide
aggctgcttttcagaggg

SEQ ID NO: 1752 - DNA, 18 bp, Artificial sequence
  Synthetic oligonucleotide
agcaggctgcttttcaga

SEQ ID NO: 1753 - DNA, 18 bp, Artificial sequence
  Synthetic oligonucleotide
agcagcaggctgcttttc

SEQ ID NO: 1754 - DNA, 18 bp, Artificial sequence
  Synthetic oligonucleotide
agcagcagcaggctgctt

SEQ ID NO: 1755 - DNA, 18 bp, Artificial sequence
  Synthetic oligonucleotide
cggagcagcagcaggctg

SEQ ID NO: 1756 - DNA, 18 bp, Artificial sequence
  Synthetic oligonucleotide
ccgcggagcagcagcagg

SEQ ID NO: 1757 - DNA, 18 bp, Artificial sequence
  Synthetic oligonucleotide
cccccgcggagcagcagc

SEQ ID NO: 1758 - DNA, 18 bp, Artificial sequence
  Synthetic oligonucleotide
cttcccccgcggagcagc

SEQ ID NO: 1759 - DNA, 18 bp, Artificial sequence
  Synthetic oligonucleotide
gggcttcccccgcggagc

SEQ ID NO: 1760 - DNA, 18 bp, Artificial sequence
  Synthetic oligonucleotide
gacgggcttcccccgcgg

SEQ ID NO: 1761 - DNA, 18 bp, Artificial sequence
  Synthetic oligonucleotide
gctgacgggcttcccccg

SEQ ID NO: 1762 - DNA, 18 bp, Artificial sequence
  Synthetic oligonucleotide
ccggctgacgggcttccc

SEQ ID NO: 1763 - DNA, 18 bp, Artificial sequence
  Synthetic oligonucleotide
gacccggctgacgggctt

SEQ ID NO: 1764 - DNA, 18 bp, Artificial sequence
  Synthetic oligonucleotide
gagggacccggctgacgg

SEQ ID NO: 1765 - DNA, 18 bp, Artificial sequence
  Synthetic oligonucleotide
gttgagggacccggctga

SEQ ID NO: 1766 - DNA, 18 bp, Artificial sequence
  Synthetic oligonucleotide
tgagttgagggacccggc

SEQ ID NO: 1767 - DNA, 18 bp, Artificial sequence
  Synthetic oligonucleotide
ctttgagttgagggaccc

SEQ ID NO: 1768 - DNA, 18 bp, Artificial sequence
  Synthetic oligonucleotide
ttttactgaccatgcgag

SEQ ID NO: 1769 - DNA, 18 bp, Artificial sequence
  Synthetic oligonucleotide
tgcttttactgaccatgc

SEQ ID NO: 1770 - DNA, 18 bp, Artificial sequence
  Synthetic oligonucleotide
ctttgcttttactgacca

SEQ ID NO: 1771 - DNA, 18 bp, Artificial sequence
  Synthetic oligonucleotide
cgtctttgcttttactga

SEQ ID NO: 1772 - DNA, 18 bp, Artificial sequence
  Synthetic oligonucleotide
tcccgtctttgcttttac

SEQ ID NO: 1773 - DNA, 18 bp, Artificial sequence
  Synthetic oligonucleotide
ccagtcccgtctttgctt

SEQ ID NO: 1774 - DNA, 18 bp, Artificial sequence
  Synthetic oligonucleotide
cttccagtcccgtctttg

SEQ ID NO: 1775 - DNA, 18 bp, Artificial sequence
  Synthetic oligonucleotide
tcgcttccagtcccgtct

SEQ ID NO: 1776 - DNA, 18 bp, Artificial sequence
  Synthetic oligonucleotide
tcatcgcttccagtcccg

SEQ ID NO: 1777 - DNA, 18 bp, Artificial sequence
  Synthetic oligonucleotide
ttgtcatcgcttccagtc

SEQ ID NO: 1778 - DNA, 18 bp, Artificial sequence
  Synthetic oligonucleotide
tttttgtcatcgcttcca

SEQ ID NO: 1779 - DNA, 18 bp, Artificial sequence
  Synthetic oligonucleotide
ggttttagcagaggaacg

SEQ ID NO: 1780 - DNA, 18 bp, Artificial sequence
  Synthetic oligonucleotide
caaggttttagcagagga

SEQ ID NO: 1781 - DNA, 18 bp, Artificial sequence
  Synthetic oligonucleotide
tttcaaggttttagcaga

SEQ ID NO: 1782 - DNA, 18 bp, Artificial sequence
  Synthetic oligonucleotide
atttttcaaggttttagc

SEQ ID NO: 1783 - DNA, 18 bp, Artificial sequence
  Synthetic oligonucleotide
cctatttttcaaggtttt

SEQ ID NO: 1784 - DNA, 18 bp, Artificial sequence
  Synthetic oligonucleotide
ggcaaggcctatttttca

SEQ ID NO: 1785 - DNA, 18 bp, Artificial sequence
  Synthetic oligonucleotide
taaggcaaggcctatttt

SEQ ID NO: 1786 - DNA, 18 bp, Artificial sequence
  Synthetic oligonucleotide
ggctaaggcaaggcctat

SEQ ID NO: 1787 - DNA, 18 bp, Artificial sequence
  Synthetic oligonucleotide
tgagctaccaggagtggg

SEQ ID NO: 1788 - DNA, 18 bp, Artificial sequence
  Synthetic oligonucleotide
gtctgagctaccaggagt

SEQ ID NO: 1789 - DNA, 18 bp, Artificial sequence
  Synthetic oligonucleotide
agggtctgagctaccagg

SEQ ID NO: 1790 - DNA, 18 bp, Artificial sequence
  Synthetic oligonucleotide
cagagggtctgagctacc

SEQ ID NO: 1791 - DNA, 18 bp, Artificial sequence
  Synthetic oligonucleotide
gatcagagggtctgagct

SEQ ID NO: 1792 - DNA, 18 bp, Artificial sequence
  Synthetic oligonucleotide
ttggatcagagggtctga

SEQ ID NO: 1793 - DNA, 18 bp, Artificial sequence
  Synthetic oligonucleotide
ggagggttggatcagagg

SEQ ID NO: 1794 - DNA, 18 bp, Artificial sequence
  Synthetic oligonucleotide
gctggagggttggatcag

SEQ ID NO: 1795 - DNA, 18 bp, Artificial sequence
  Synthetic oligonucleotide
acacagcagggctggagg

SEQ ID NO: 1796 - DNA, 18 bp, Artificial sequence
  Synthetic oligonucleotide
ggcacacagcagggctgg

SEQ ID NO: 1797 - DNA, 18 bp, Artificial sequence
  Synthetic oligonucleotide
ctctgggcacacagcagg

SEQ ID NO: 1798 - DNA, 18 bp, Artificial sequence
  Synthetic oligonucleotide
tggctctgggcacacagc

SEQ ID NO: 1799 - DNA, 18 bp, Artificial sequence
  Synthetic oligonucleotide
aggtggctctgggcacac

SEQ ID NO: 1800 - DNA, 18 bp, Artificial sequence
  Synthetic oligonucleotide
ggaaggtggctctgggca

SEQ ID NO: 1801 - DNA, 18 bp, Artificial sequence
  Synthetic oligonucleotide
agaggaaggtggctctgg

SEQ ID NO: 1802 - DNA, 18 bp, Artificial sequence
  Synthetic oligonucleotide
aggagaggaaggtggctc

SEQ ID NO: 1803 - DNA, 18 bp, Artificial sequence
  Synthetic oligonucleotide
tttaggagaggaaggtgg

SEQ ID NO: 1804 - DNA, 18 bp, Artificial sequence
  Synthetic oligonucleotide
gtatttaggagaggaagg

SEQ ID NO: 1805 - DNA, 18 bp, Artificial sequence
  Synthetic oligonucleotide
gaagtgacagaagagacg

SEQ ID NO: 1806 - DNA, 18 bp, Artificial sequence
  Synthetic oligonucleotide
cgggaagtgacagaagag

SEQ ID NO: 1807 - DNA, 18 bp, Artificial sequence
  Synthetic oligonucleotide
gttcgggaagtgacagaa

SEQ ID NO: 1808 - DNA, 18 bp, Artificial sequence
  Synthetic oligonucleotide
ccagttcgggaagtgaca

SEQ ID NO: 1809 - DNA, 18 bp, Artificial sequence
  Synthetic oligonucleotide
ctgccagttcgggaagtg

SEQ ID NO: 1810 - DNA, 18 bp, Artificial sequence
  Synthetic oligonucleotide
gaactgccagttcgggaa

SEQ ID NO: 1811 - DNA, 18 bp, Artificial sequence
  Synthetic oligonucleotide
ccagaactgccagttcgg

SEQ ID NO: 1812 - DNA, 18 bp, Artificial sequence
  Synthetic oligonucleotide
gctccagaactgccagtt

SEQ ID NO: 1813 - DNA, 18 bp, Artificial sequence
  Synthetic oligonucleotide
tttgctccagaactgcca

SEQ ID NO: 1814 - DNA, 18 bp, Artificial sequence
  Synthetic oligonucleotide
tcctttgctccagaactg

SEQ ID NO: 1815 - DNA, 18 bp, Artificial sequence
  Synthetic oligonucleotide
atctcctttgctccagaa

SEQ ID NO: 1816 - DNA, 18 bp, Artificial sequence
  Synthetic oligonucleotide
ttcatctcctttgctcca

SEQ ID NO: 1817 - DNA, 18 bp, Artificial sequence
  Synthetic oligonucleotide
agtttcatctcctttgct

SEQ ID NO: 1818 - DNA, 18 bp, Artificial sequence
  Synthetic oligonucleotide
cccttgagtttcatctcc

SEQ ID NO: 1819 - DNA, 18 bp, Artificial sequence
  Synthetic oligonucleotide
gcccccttgagtttcatc

SEQ ID NO: 1820 - DNA, 18 bp, Artificial sequence
  Synthetic oligonucleotide
tcagcccccttgagtttc

SEQ ID NO: 1821 - DNA, 18 bp, Artificial sequence
  Synthetic oligonucleotide
ccatcagcccccttgagt

SEQ ID NO: 1822 - DNA, 18 bp, Artificial sequence
  Synthetic oligonucleotide
ttaccatcagcccccttg

SEQ ID NO: 1823 - DNA, 18 bp, Artificial sequence
  Synthetic oligonucleotide
cgcagagctgggtggtgt

SEQ ID NO: 1824 - DNA, 18 bp, Artificial sequence
  Synthetic oligonucleotide
agtcgcagagctgggtgg

SEQ ID NO: 1825 - DNA, 18 bp, Artificial sequence
  Synthetic oligonucleotide
cttagtcgcagagctggg

SEQ ID NO: 1826 - DNA, 18 bp, Artificial sequence
  Synthetic oligonucleotide
ttgcttagtcgcagagct

SEQ ID NO: 1827 - DNA, 18 bp, Artificial sequence
  Synthetic oligonucleotide
gacttgcttagtcgcaga

SEQ ID NO: 1828 - DNA, 18 bp, Artificial sequence
  Synthetic oligonucleotide
ttcacctctctcagatct

SEQ ID NO: 1829 - DNA, 18 bp, Artificial sequence
  Synthetic oligonucleotide
aggttcacctctctcaga

SEQ ID NO: 1830 - DNA, 18 bp, Artificial sequence
  Synthetic oligonucleotide
tggaggttcacctctctc

SEQ ID NO: 1831 - DNA, 18 bp, Artificial sequence
  Synthetic oligonucleotide
ttttggaggttcacctct

SEQ ID NO: 1832 - DNA, 18 bp, Artificial sequence
  Synthetic oligonucleotide
ttgagtttcatctccttt

SEQ ID NO: 1833 - DNA, 18 bp, Artificial sequence
  Synthetic oligonucleotide
gttttaccatcagccccc

SEQ ID NO: 1834 - DNA, 18 bp, Artificial sequence
  Synthetic oligonucleotide
gcggtgtggcgatcttcg

SEQ ID NO: 1835 - DNA, 18 bp, Artificial sequence
  Synthetic oligonucleotide
cccgcggtgtggcgatct

SEQ ID NO: 1836 - DNA, 18 bp, Artificial sequence
  Synthetic oligonucleotide
ctccccgcggtgtggcga

SEQ ID NO: 1837 - DNA, 18 bp, Artificial sequence
  Synthetic oligonucleotide
ctgctccccgcggtgtgg

SEQ ID NO: 1838 - DNA, 18 bp, Artificial sequence
  Synthetic oligonucleotide
gggctgctccccgcggtg

SEQ ID NO: 1839 - DNA, 18 bp, Artificial sequence
  Synthetic oligonucleotide
ggcccttctggcctggag

SEQ ID NO: 1840 - DNA, 18 bp, Artificial sequence
  Synthetic oligonucleotide
gcctggcccttctggcct

SEQ ID NO: 1841 - DNA, 18 bp, Artificial sequence
  Synthetic oligonucleotide
ttggcctggcccttctgg

SEQ ID NO: 1842 - DNA, 18 bp, Artificial sequence
  Synthetic oligonucleotide
gctggaatcctggtggcg

SEQ ID NO: 1843 - DNA, 18 bp, Artificial sequence
  Synthetic oligonucleotide
tttgctggaatcctggtg

SEQ ID NO: 1844 - DNA, 18 bp, Artificial sequence
  Synthetic oligonucleotide
gtttttgctggaatcctg

SEQ ID NO: 1845 - DNA, 18 bp, Artificial sequence
  Synthetic oligonucleotide
tgtctttggagcgggcgg

SEQ ID NO: 1846 - DNA, 18 bp, Artificial sequence
  Synthetic oligonucleotide
tggtgtctttggagcggg

SEQ ID NO: 1847 - DNA, 18 bp, Artificial sequence
  Synthetic oligonucleotide
gggtggtgtctttggagc

SEQ ID NO: 1848 - DNA, 18 bp, Artificial sequence
  Synthetic oligonucleotide
gctgggtggtgtctttgg

SEQ ID NO: 1849 - DNA, 18 bp, Artificial sequence
  Synthetic oligonucleotide
agagctgggtggtgtctt

SEQ ID NO: 1850 - DNA, 18 bp, Artificial sequence
  Synthetic oligonucleotide
ctggacttgcttagtcgc

SEQ ID NO: 1851 - DNA, 18 bp, Artificial sequence
  Synthetic oligonucleotide
tctctggacttgcttagt

SEQ ID NO: 1852 - DNA, 18 bp, Artificial sequence
  Synthetic oligonucleotide
tcttctctggacttgctt

SEQ ID NO: 1853 - DNA, 18 bp, Artificial sequence
  Synthetic oligonucleotide
tggtcttctctggacttg

SEQ ID NO: 1854 - DNA, 18 bp, Artificial sequence
  Synthetic oligonucleotide
gggtggtcttctctggac

SEQ ID NO: 1855 - DNA, 18 bp, Artificial sequence
  Synthetic oligonucleotide
cagatctgggccctgcag

SEQ ID NO: 1856 - DNA, 18 bp, Artificial sequence
  Synthetic oligonucleotide
tctcagatctgggccctg

SEQ ID NO: 1857 - DNA, 18 bp, Artificial sequence
  Synthetic oligonucleotide
ctctctcagatctgggcc

SEQ ID NO: 1858 - DNA, 18 bp, Artificial sequence
  Synthetic oligonucleotide
tgattttggaggttcacc

SEQ ID NO: 1859 - DNA, 18 bp, Artificial sequence
  Synthetic oligonucleotide
ccctgattttggaggttc

SEQ ID NO: 1860 - DNA, 18 bp, Artificial sequence
  Synthetic oligonucleotide
atcccctgattttggagg

SEQ ID NO: 1861 - DNA, 18 bp, Artificial sequence
  Synthetic oligonucleotide
gcgatcccctgattttgg

SEQ ID NO: 1862 - DNA, 18 bp, Artificial sequence
  Synthetic oligonucleotide
gctgcgatcccctgattt

SEQ ID NO: 1863 - DNA, 18 bp, Artificial sequence
  Synthetic oligonucleotide
gccgctgcgatcccctga

SEQ ID NO: 1864 - DNA, 18 bp, Artificial sequence
  Synthetic oligonucleotide
gtagccgctgcgatcccc

SEQ ID NO: 1865 - DNA, 18 bp, Artificial sequence
  Synthetic oligonucleotide
gctgtagccgctgcgatc

SEQ ID NO: 1866 - DNA, 18 bp, Artificial sequence
  Synthetic oligonucleotide
gctgctgtagccgctgcg

SEQ ID NO: 1867 - DNA, 18 bp, Artificial sequence
  Synthetic oligonucleotide
gcggctgccgggagtgcc

SEQ ID NO: 1868 - DNA, 18 bp, Artificial sequence
  Synthetic oligonucleotide
ggagcggctgccgggagt

SEQ ID NO: 1869 - DNA, 18 bp, Artificial sequence
  Synthetic oligonucleotide
tgcgggagcggctgccgg

SEQ ID NO: 1870 - DNA, 18 bp, Artificial sequence
  Synthetic oligonucleotide
accttcttgggctcccgg

SEQ ID NO: 1871 - DNA, 18 bp, Artificial sequence
  Synthetic oligonucleotide
gccaccttcttgggctcc

SEQ ID NO: 1872 - DNA, 18 bp, Artificial sequence
  Synthetic oligonucleotide
actgccaccttcttgggc

SEQ ID NO: 1873 - DNA, 18 bp, Artificial sequence
  Synthetic oligonucleotide
accactgccaccttcttg

SEQ ID NO: 1874 - DNA, 18 bp, Artificial sequence
  Synthetic oligonucleotide
cggaccactgccaccttc

SEQ ID NO: 1875 - DNA, 18 bp, Artificial sequence
  Synthetic oligonucleotide
gtacggaccactgccacc

SEQ ID NO: 1876 - DNA, 18 bp, Artificial sequence
  Synthetic oligonucleotide
ggagtacggaccactgcc

SEQ ID NO: 1877 - DNA, 18 bp, Artificial sequence
  Synthetic oligonucleotide
ggtggagtacggaccact

SEQ ID NO: 1878 - DNA, 18 bp, Artificial sequence
  Synthetic oligonucleotide
ttgggtggagtacggacc

SEQ ID NO: 1879 - DNA, 18 bp, Artificial sequence
  Synthetic oligonucleotide
cggcgacttgggtggagt

SEQ ID NO: 1880 - DNA, 18 bp, Artificial sequence
  Synthetic oligonucleotide
agacggcgacttgggtgg

SEQ ID NO: 1881 - DNA, 18 bp, Artificial sequence
  Synthetic oligonucleotide
ggaagacggcgacttggg

SEQ ID NO: 1882 - DNA, 18 bp, Artificial sequence
  Synthetic oligonucleotide
ggcggaagacggcgactt

SEQ ID NO: 1883 - DNA, 18 bp, Artificial sequence
  Synthetic oligonucleotide
cttggcggaagacggcga

SEQ ID NO: 1884 - DNA, 18 bp, Artificial sequence
  Synthetic oligonucleotide
gctcttggcggaagacgg

SEQ ID NO: 1885 - DNA, 18 bp, Artificial sequence
  Synthetic oligonucleotide
gcggctcttggcggaaga

SEQ ID NO: 1886 - DNA, 18 bp, Artificial sequence
  Synthetic oligonucleotide
caggcggctcttggcgga

SEQ ID NO: 1887 - DNA, 18 bp, Artificial sequence
  Synthetic oligonucleotide
ctgcaggcggctcttggc

SEQ ID NO: 1888 - DNA, 18 bp, Artificial sequence
  Synthetic oligonucleotide
tgtctgcaggcggctctt

SEQ ID NO: 1889 - DNA, 18 bp, Artificial sequence
  Synthetic oligonucleotide
ggctgtctgcaggcggct

SEQ ID NO: 1890 - DNA, 18 bp, Artificial sequence
  Synthetic oligonucleotide
ggtctggcatgggcacgg

SEQ ID NO: 1891 - DNA, 18 bp, Artificial sequence
  Synthetic oligonucleotide
tctcagtggagccgatct

SEQ ID NO: 1892 - DNA, 18 bp, Artificial sequence
  Synthetic oligonucleotide
ggttctcagtggagccga

SEQ ID NO: 1893 - DNA, 18 bp, Artificial sequence
  Synthetic oligonucleotide
tcaggttctcagtggagc

SEQ ID NO: 1894 - DNA, 18 bp, Artificial sequence
  Synthetic oligonucleotide
gcttcaggttctcagtgg

SEQ ID NO: 1895 - DNA, 18 bp, Artificial sequence
  Synthetic oligonucleotide
tgcaccttcccgcctccc

SEQ ID NO: 1896 - DNA, 18 bp, Artificial sequence
  Synthetic oligonucleotide
tatctgcaccttcccgcc

SEQ ID NO: 1897 - DNA, 18 bp, Artificial sequence
  Synthetic oligonucleotide
aattatctgcaccttccc

SEQ ID NO: 1898 - DNA, 18 bp, Artificial sequence
  Synthetic oligonucleotide
tgcacactgccgcctccc

SEQ ID NO: 1899 - DNA, 18 bp, Artificial sequence
  Synthetic oligonucleotide
actatttgcacactgccg

SEQ ID NO: 1900 - DNA, 18 bp, Artificial sequence
  Synthetic oligonucleotide
tagactatttgcacactg

SEQ ID NO: 1901 - DNA, 18 bp, Artificial sequence
  Synthetic oligonucleotide
ttgtagactatttgcaca

SEQ ID NO: 1902 - DNA, 18 bp, Artificial sequence
  Synthetic oligonucleotide
ctcctggtttatgatgga

SEQ ID NO: 1903 - DNA, 18 bp, Artificial sequence
  Synthetic oligonucleotide
ggccacctcctggtttat

SEQ ID NO: 1904 - DNA, 18 bp, Artificial sequence
  Synthetic oligonucleotide
cacctggccacctcctgg

SEQ ID NO: 1905 - DNA, 18 bp, Artificial sequence
  Synthetic oligonucleotide
atctttttatttcctccg

SEQ ID NO: 1906 - DNA, 18 bp, Artificial sequence
  Synthetic oligonucleotide
tttcaatctttttatttc

SEQ ID NO: 1907 - DNA, 18 bp, Artificial sequence
  Synthetic oligonucleotide
ggtgcttcaggttctcag

SEQ ID NO: 1908 - DNA, 18 bp, Artificial sequence
  Synthetic oligonucleotide
ggctggtgcttcaggttc

SEQ ID NO: 1909 - DNA, 18 bp, Artificial sequence
  Synthetic oligonucleotide
cccggctggtgcttcagg

SEQ ID NO: 1910 - DNA, 18 bp, Artificial sequence
  Synthetic oligonucleotide
cctcccggctggtgcttc

SEQ ID NO: 1911 - DNA, 18 bp, Artificial sequence
  Synthetic oligonucleotide
ccgcctcccggctggtgc

SEQ ID NO: 1912 - DNA, 18 bp, Artificial sequence
  Synthetic oligonucleotide
ttcccgcctcccggctgg

SEQ ID NO: 1913 - DNA, 18 bp, Artificial sequence
  Synthetic oligonucleotide
accttcccgcctcccggc

SEQ ID NO: 1914 - DNA, 18 bp, Artificial sequence
  Synthetic oligonucleotide
attaattatctgcacctt

SEQ ID NO: 1915 - DNA, 18 bp, Artificial sequence
  Synthetic oligonucleotide
cttattaattatctgcac

SEQ ID NO: 1916 - DNA, 18 bp, Artificial sequence
  Synthetic oligonucleotide
gcttcttattaattatct

SEQ ID NO: 1917 - DNA, 18 bp, Artificial sequence
  Synthetic oligonucleotide
ccagcttcttattaatta

SEQ ID NO: 1918 - DNA, 18 bp, Artificial sequence
  Synthetic oligonucleotide
gatccagcttcttattaa

SEQ ID NO: 1919 - DNA, 18 bp, Artificial sequence
  Synthetic oligonucleotide
taagatccagcttcttat

SEQ ID NO: 1920 - DNA, 18 bp, Artificial sequence
  Synthetic oligonucleotide
tgctaagatccagcttct

SEQ ID NO: 1921 - DNA, 18 bp, Artificial sequence
  Synthetic oligonucleotide
cgttgctaagatccagct

SEQ ID NO: 1922 - DNA, 18 bp, Artificial sequence
  Synthetic oligonucleotide
ccacacttggactggacg

SEQ ID NO: 1923 - DNA, 18 bp, Artificial sequence
  Synthetic oligonucleotide
gagccacacttggactgg

SEQ ID NO: 1924 - DNA, 18 bp, Artificial sequence
  Synthetic oligonucleotide
tttgagccacacttggac

SEQ ID NO: 1925 - DNA, 18 bp, Artificial sequence
  Synthetic oligonucleotide
tcctttgagccacacttg

SEQ ID NO: 1926 - DNA, 18 bp, Artificial sequence
  Synthetic oligonucleotide
ttatcctttgagccacac

SEQ ID NO: 1927 - DNA, 18 bp, Artificial sequence
  Synthetic oligonucleotide
atattatcctttgagcca

SEQ ID NO: 1928 - DNA, 18 bp, Artificial sequence
  Synthetic oligonucleotide
ttgatattatcctttgag

SEQ ID NO: 1929 - DNA, 18 bp, Artificial sequence
  Synthetic oligonucleotide
tgtttgatattatccttt

SEQ ID NO: 1930 - DNA, 18 bp, Artificial sequence
  Synthetic oligonucleotide
ctgccgcctcccgggacg

SEQ ID NO: 1931 - DNA, 18 bp, Artificial sequence
  Synthetic oligonucleotide
acactgccgcctcccggg

SEQ ID NO: 1932 - DNA, 18 bp, Artificial sequence
  Synthetic oligonucleotide
ggtttgtagactatttgc

SEQ ID NO: 1933 - DNA, 18 bp, Artificial sequence
  Synthetic oligonucleotide
actggtttgtagactatt

SEQ ID NO: 1934 - DNA, 18 bp, Artificial sequence
  Synthetic oligonucleotide
tcaactggtttgtagact

SEQ ID NO: 1935 - DNA, 18 bp, Artificial sequence
  Synthetic oligonucleotide
gctcaggtcaactggttt

SEQ ID NO: 1936 - DNA, 18 bp, Artificial sequence
  Synthetic oligonucleotide
cttgctcaggtcaactgg

SEQ ID NO: 1937 - DNA, 18 bp, Artificial sequence
  Synthetic oligonucleotide
caccttgctcaggtcaac

SEQ ID NO: 1938 - DNA, 18 bp, Artificial sequence
  Synthetic oligonucleotide
ctaatgagccacacttgg

SEQ ID NO: 1939 - DNA, 18 bp, Artificial sequence
  Synthetic oligonucleotide
tgcctaatgagccacact

SEQ ID NO: 1940 - DNA, 18 bp, Artificial sequence
  Synthetic oligonucleotide
tgttgcctaatgagccac

SEQ ID NO: 1941 - DNA, 18 bp, Artificial sequence
  Synthetic oligonucleotide
ggatgttgcctaatgagc

SEQ ID NO: 1942 - DNA, 18 bp, Artificial sequence
  Synthetic oligonucleotide
gatggatgttgcctaatg

SEQ ID NO: 1943 - DNA, 18 bp, Artificial sequence
  Synthetic oligonucleotide
tatgatggatgttgccta

SEQ ID NO: 1944 - DNA, 18 bp, Artificial sequence
  Synthetic oligonucleotide
gtttatgatggatgttgc

SEQ ID NO: 1945 - DNA, 18 bp, Artificial sequence
  Synthetic oligonucleotide
ctggtttatgatggatgt

SEQ ID NO: 1946 - DNA, 18 bp, Artificial sequence
  Synthetic oligonucleotide
tttacttccacctggcca

SEQ ID NO: 1947 - DNA, 18 bp, Artificial sequence
  Synthetic oligonucleotide
gattttacttccacctgg

SEQ ID NO: 1948 - DNA, 18 bp, Artificial sequence
  Synthetic oligonucleotide
tcagattttacttccacc

SEQ ID NO: 1949 - DNA, 18 bp, Artificial sequence
  Synthetic oligonucleotide
ttctcagattttacttcc

SEQ ID NO: 1950 - DNA, 18 bp, Artificial sequence
  Synthetic oligonucleotide
agcttctcagattttact

SEQ ID NO: 1951 - DNA, 18 bp, Artificial sequence
  Synthetic oligonucleotide
tcaagcttctcagatttt

SEQ ID NO: 1952 - DNA, 18 bp, Artificial sequence
  Synthetic oligonucleotide
aagtcaagcttctcagat

SEQ ID NO: 1953 - DNA, 18 bp, Artificial sequence
  Synthetic oligonucleotide
ttgaagtcaagcttctca

SEQ ID NO: 1954 - DNA, 18 bp, Artificial sequence
  Synthetic oligonucleotide
tccttgaagtcaagcttc

SEQ ID NO: 1955 - DNA, 18 bp, Artificial sequence
  Synthetic oligonucleotide
ctgtccttgaagtcaagc

SEQ ID NO: 1956 - DNA, 18 bp, Artificial sequence
  Synthetic oligonucleotide
actctgtccttgaagtca

SEQ ID NO: 1957 - DNA, 18 bp, Artificial sequence
  Synthetic oligonucleotide
tggactctgtccttgaag

SEQ ID NO: 1958 - DNA, 18 bp, Artificial sequence
  Synthetic oligonucleotide
gactggactctgtccttg

SEQ ID NO: 1959 - DNA, 18 bp, Artificial sequence
  Synthetic oligonucleotide
ttcgactggactctgtcc

SEQ ID NO: 1960 - DNA, 18 bp, Artificial sequence
  Synthetic oligonucleotide
atcttcgactggactctg

SEQ ID NO: 1961 - DNA, 18 bp, Artificial sequence
  Synthetic oligonucleotide
ccaatcttcgactggact

SEQ ID NO: 1962 - DNA, 18 bp, Artificial sequence
  Synthetic oligonucleotide
gacccaatcttcgactgg

SEQ ID NO: 1963 - DNA, 18 bp, Artificial sequence
  Synthetic oligonucleotide
agggacccaatcttcgac

SEQ ID NO: 1964 - DNA, 18 bp, Artificial sequence
  Synthetic oligonucleotide
tccagggacccaatcttc

SEQ ID NO: 1965 - DNA, 18 bp, Artificial sequence
  Synthetic oligonucleotide
ttgtccagggacccaatc

SEQ ID NO: 1966 - DNA, 18 bp, Artificial sequence
  Synthetic oligonucleotide
atattgtccagggaccca

SEQ ID NO: 1967 - DNA, 18 bp, Artificial sequence
  Synthetic oligonucleotide
gtgatattgtccagggac

SEQ ID NO: 1968 - DNA, 18 bp, Artificial sequence
  Synthetic oligonucleotide
tgggtgatattgtccagg

SEQ ID NO: 1969 - DNA, 18 bp, Artificial sequence
  Synthetic oligonucleotide
tttcctccgccagggacg

SEQ ID NO: 1970 - DNA, 18 bp, Artificial sequence
  Synthetic oligonucleotide
ttatttcctccgccaggg

SEQ ID NO: 1971 - DNA, 18 bp, Artificial sequence
  Synthetic oligonucleotide
tttttatttcctccgcca

SEQ ID NO: 1972 - DNA, 18 bp, Artificial sequence
  Synthetic oligonucleotide
gggtttcaatctttttat

SEQ ID NO: 1973 - DNA, 18 bp, Artificial sequence
  Synthetic oligonucleotide
gtcagcttgtgggtttca

SEQ ID NO: 1974 - DNA, 18 bp, Artificial sequence
  Synthetic oligonucleotide
aaggtcagcttgtgggtt

SEQ ID NO: 1975 - DNA, 18 bp, Artificial sequence
  Synthetic oligonucleotide
gcggaaggtcagcttgtg

SEQ ID NO: 1976 - DNA, 18 bp, Artificial sequence
  Synthetic oligonucleotide
tctcgcggaaggtcagct

SEQ ID NO: 1977 - DNA, 18 bp, Artificial sequence
  Synthetic oligonucleotide
cgttctcgcggaaggtca

SEQ ID NO: 1978 - DNA, 18 bp, Artificial sequence
  Synthetic oligonucleotide
tctgtcttggctttggcg

SEQ ID NO: 1979 - DNA, 18 bp, Artificial sequence
  Synthetic oligonucleotide
tggtctgtcttggctttg

SEQ ID NO: 1980 - DNA, 18 bp, Artificial sequence
  Synthetic oligonucleotide
ccgtggtctgtcttggct

SEQ ID NO: 1981 - DNA, 18 bp, Artificial sequence
  Synthetic oligonucleotide
gccccgtggtctgtcttg

SEQ ID NO: 1982 - DNA, 18 bp, Artificial sequence
  Synthetic oligonucleotide
acacgatctccgccccgt

SEQ ID NO: 1983 - DNA, 18 bp, Artificial sequence
  Synthetic oligonucleotide
tgtacacgatctccgccc

SEQ ID NO: 1984 - DNA, 18 bp, Artificial sequence
  Synthetic oligonucleotide
acttgtacacgatctccg

SEQ ID NO: 1985 - DNA, 18 bp, Artificial sequence
  Synthetic oligonucleotide
gcgacttgtacacgatct

SEQ ID NO: 1986 - DNA, 18 bp, Artificial sequence
  Synthetic oligonucleotide
ctggcgacttgtacacga

SEQ ID NO: 1987 - DNA, 18 bp, Artificial sequence
  Synthetic oligonucleotide
ccactggcgacttgtaca

SEQ ID NO: 1988 - DNA, 18 bp, Artificial sequence
  Synthetic oligonucleotide
acaccactggcgacttgt

SEQ ID NO: 1989 - DNA, 18 bp, Artificial sequence
  Synthetic oligonucleotide
cagacaccactggcgact

SEQ ID NO: 1990 - DNA, 18 bp, Artificial sequence
  Synthetic oligonucleotide
ccccagacaccactggcg

SEQ ID NO: 1991 - DNA, 18 bp, Artificial sequence
  Synthetic oligonucleotide
tgtccccagacaccactg

SEQ ID NO: 1992 - DNA, 18 bp, Artificial sequence
  Synthetic oligonucleotide
tgagatgccgtggagacg

SEQ ID NO: 1993 - DNA, 18 bp, Artificial sequence
  Synthetic oligonucleotide
tgctgagatgccgtggag

SEQ ID NO: 1994 - DNA, 18 bp, Artificial sequence
  Synthetic oligonucleotide
cgatgctgccggtggagg

SEQ ID NO: 1995 - DNA, 18 bp, Artificial sequence
  Synthetic oligonucleotide
tgtcgatgctgccggtgg

SEQ ID NO: 1996 - DNA, 18 bp, Artificial sequence
  Synthetic oligonucleotide
ccatgtcgatgctgccgg

SEQ ID NO: 1997 - DNA, 18 bp, Artificial sequence
  Synthetic oligonucleotide
ctaccatgtcgatgctgc

SEQ ID NO: 1998 - DNA, 18 bp, Artificial sequence
  Synthetic oligonucleotide
agtctaccatgtcgatgc

SEQ ID NO: 1999 - DNA, 18 bp, Artificial sequence
  Synthetic oligonucleotide
gcgagtctaccatgtcga

SEQ ID NO: 2000 - DNA, 18 bp, Artificial sequence
  Synthetic oligonucleotide
agggaggcagacacctcg

SEQ ID NO: 2001 - DNA, 18 bp, Artificial sequence
  Synthetic oligonucleotide
gccagggaggcagacacc

SEQ ID NO: 2002 - DNA, 18 bp, Artificial sequence
  Synthetic oligonucleotide
cttggccagggaggcaga

SEQ ID NO: 2003 - DNA, 18 bp, Artificial sequence
  Synthetic oligonucleotide
ctgcttggccagggaggc

SEQ ID NO: 2004 - DNA, 18 bp, Artificial sequence
  Synthetic oligonucleotide
accctgcttggccaggga

SEQ ID NO: 2005 - DNA, 18 bp, Artificial sequence
  Synthetic oligonucleotide
cctgatcacaaaccctgc

SEQ ID NO: 2006 - DNA, 18 bp, Artificial sequence
  Synthetic oligonucleotide
gggcctgatcacaaaccc

SEQ ID NO: 2007 - DNA, 18 bp, Artificial sequence
  Synthetic oligonucleotide
ttattgaccgccccaggg

SEQ ID NO: 2008 - DNA, 18 bp, Artificial sequence
  Synthetic oligonucleotide
caattattgaccgcccca

SEQ ID NO: 2009 - DNA, 18 bp, Artificial sequence
  Synthetic oligonucleotide
ccacaattattgaccgcc

SEQ ID NO: 2010 - DNA, 18 bp, Artificial sequence
  Synthetic oligonucleotide
tctccacaattattgacc

SEQ ID NO: 2011 - DNA, 18 bp, Artificial sequence
  Synthetic oligonucleotide
tcctctccacaattattg

SEQ ID NO: 2012 - DNA, 18 bp, Artificial sequence
  Synthetic oligonucleotide
ctctcctctccacaatta

SEQ ID NO: 2013 - DNA, 18 bp, Artificial sequence
  Synthetic oligonucleotide
attctctcctctccacaa

SEQ ID NO: 2014 - DNA, 18 bp, Artificial sequence
  Synthetic oligonucleotide
ctcattctctcctctcca

SEQ ID NO: 2015 - DNA, 18 bp, Artificial sequence
  Synthetic oligonucleotide
tctctcattctctcctct

SEQ ID NO: 2016 - DNA, 18 bp, Artificial sequence
  Synthetic oligonucleotide
cactctctcattctctcc

SEQ ID NO: 2017 - DNA, 18 bp, Artificial sequence
  Synthetic oligonucleotide
ccacactctctcattctc

SEQ ID NO: 2018 - DNA, 18 bp, Artificial sequence
  Synthetic oligonucleotide
tttccacactctctcatt

SEQ ID NO: 2019 - DNA, 18 bp, Artificial sequence
  Synthetic oligonucleotide
ttttttccacactctctc

SEQ ID NO: 2020 - DNA, 18 bp, Artificial sequence
  Synthetic oligonucleotide
ctttttttttccacactc

SEQ ID NO: 2021 - DNA, 18 bp, Artificial sequence
  Synthetic oligonucleotide
attctttttttttccaca

SEQ ID NO: 2022 - DNA, 18 bp, Artificial sequence
  Synthetic oligonucleotide
gtcattattctttttttt

SEQ ID NO: 2023 - DNA, 18 bp, Artificial sequence
  Synthetic oligonucleotide
cgggtcattattcttttt

SEQ ID NO: 2024 - DNA, 18 bp, Artificial sequence
  Synthetic oligonucleotide
ggccgggtcattattctt

SEQ ID NO: 2025 - DNA, 18 bp, Artificial sequence
  Synthetic oligonucleotide
ctgcgaggagcagctggg

SEQ ID NO: 2026 - DNA, 18 bp, Artificial sequence
  Synthetic oligonucleotide
gaactgcgaggagcagct

SEQ ID NO: 2027 - DNA, 18 bp, Artificial sequence
  Synthetic oligonucleotide
accgaactgcgaggagca

SEQ ID NO: 2028 - DNA, 18 bp, Artificial sequence
  Synthetic oligonucleotide
ttaaccgaactgcgagga

SEQ ID NO: 2029 - DNA, 18 bp, Artificial sequence
  Synthetic oligonucleotide
caattaaccgaactgcga

SEQ ID NO: 2030 - DNA, 18 bp, Artificial sequence
  Synthetic oligonucleotide
aaccaattaaccgaactg

SEQ ID NO: 2031 - DNA, 18 bp, Artificial sequence
  Synthetic oligonucleotide
attaaccaattaaccgaa

SEQ ID NO: 2032 - DNA, 18 bp, Artificial sequence
  Synthetic oligonucleotide
gtgattaaccaattaacc

SEQ ID NO: 2033 - DNA, 18 bp, Artificial sequence
  Synthetic oligonucleotide
taagtgattaaccaatta

SEQ ID NO: 2034 - DNA, 18 bp, Artificial sequence
  Synthetic oligonucleotide
ggttaagtgattaaccaa

SEQ ID NO: 2035 - DNA, 18 bp, Artificial sequence
  Synthetic oligonucleotide
gcaggttaagtgattaac

SEQ ID NO: 2036 - DNA, 18 bp, Artificial sequence
  Synthetic oligonucleotide
aaagcaggttaagtgatt

SEQ ID NO: 2037 - DNA, 18 bp, Artificial sequence
  Synthetic oligonucleotide
acaaaagcaggttaagtg

SEQ ID NO: 2038 - DNA, 18 bp, Artificial sequence
  Synthetic oligonucleotide
gtgacaaaagcaggttaa

SEQ ID NO: 2039 - DNA, 18 bp, Artificial sequence
  Synthetic oligonucleotide
cgagtgacaaaagcaggt

SEQ ID NO: 2040 - DNA, 18 bp, Artificial sequence
  Synthetic oligonucleotide
agccgagtgacaaaagca

SEQ ID NO: 2041 - DNA, 18 bp, Artificial sequence
  Synthetic oligonucleotide
caaagccgagtgacaaaa

SEQ ID NO: 2042 - DNA, 18 bp, Artificial sequence
  Synthetic oligonucleotide
agccaaagccgagtgaca

SEQ ID NO: 2043 - DNA, 18 bp, Artificial sequence
  Synthetic oligonucleotide
ccgagccaaagccgagtg

SEQ ID NO: 2044 - DNA, 18 bp, Artificial sequence
  Synthetic oligonucleotide
gtcccgagccaaagccga

SEQ ID NO: 2045 - DNA, 18 bp, Artificial sequence
  Synthetic oligonucleotide
gaagtcccgagccaaagc

SEQ ID NO: 2046 - DNA, 18 bp, Artificial sequence
  Synthetic oligonucleotide
tttgaagtcccgagccaa

SEQ ID NO: 2047 - DNA, 18 bp, Artificial sequence
  Synthetic oligonucleotide
gattttgaagtcccgagc

SEQ ID NO: 2048 - DNA, 18 bp, Artificial sequence
  Synthetic oligonucleotide
actgattttgaagtcccg

SEQ ID NO: 2049 - DNA, 18 bp, Artificial sequence
  Synthetic oligonucleotide
tgtttggatttctatcgg

SEQ ID NO: 2050 - DNA, 18 bp, Artificial sequence
  Synthetic oligonucleotide
tgacatggtgtttggatt

SEQ ID NO: 2051 - DNA, 18 bp, Artificial sequence
  Synthetic oligonucleotide
gctgacatggtgtttgga

SEQ ID NO: 2052 - DNA, 18 bp, Artificial sequence
  Synthetic oligonucleotide
cgctgacatggtgtttgg

SEQ ID NO: 2053 - DNA, 18 bp, Artificial sequence
  Synthetic oligonucleotide
tcgctgacatggtgtttg

SEQ ID NO: 2054 - DNA, 18 bp, Artificial sequence
  Synthetic oligonucleotide
ctcgctgacatggtgttt

SEQ ID NO: 2055 - DNA, 18 bp, Artificial sequence
  Synthetic oligonucleotide
actcgctgacatggtgtt

SEQ ID NO: 2056 - DNA, 18 bp, Artificial sequence
  Synthetic oligonucleotide
gactcgctgacatggtgt

SEQ ID NO: 2057 - DNA, 18 bp, Artificial sequence
  Synthetic oligonucleotide
ggactcgctgacatggtg

SEQ ID NO: 2058 - DNA, 18 bp, Artificial sequence
  Synthetic oligonucleotide
ttatccaggaaaaatatt

SEQ ID NO: 2059 - DNA, 18 bp, Artificial sequence
  Synthetic oligonucleotide
ggattatccaggaaaaat

SEQ ID NO: 2060 - DNA, 18 bp, Artificial sequence
  Synthetic oligonucleotide
taggattatccaggaaaa

SEQ ID NO: 2061 - DNA, 18 bp, Artificial sequence
  Synthetic oligonucleotide
ataggattatccaggaaa

SEQ ID NO: 2062 - DNA, 18 bp, Artificial sequence
  Synthetic oligonucleotide
tataggattatccaggaa

SEQ ID NO: 2063 - DNA, 18 bp, Artificial sequence
  Synthetic oligonucleotide
ctataggattatccagga

SEQ ID NO: 2064 - DNA, 18 bp, Artificial sequence
  Synthetic oligonucleotide
ccctataggattatccag

SEQ ID NO: 2065 - DNA, 18 bp, Artificial sequence
  Synthetic oligonucleotide
tccctataggattatcca

SEQ ID NO: 2066 - DNA, 18 bp, Artificial sequence
  Synthetic oligonucleotide
tatccctataggattatc

SEQ ID NO: 2067 - DNA, 18 bp, Artificial sequence
  Synthetic oligonucleotide
agttatccctataggatt

SEQ ID NO: 2068 - DNA, 18 bp, Artificial sequence
  Synthetic oligonucleotide
aggcaagttatccctata

SEQ ID NO: 2069 - DNA, 18 bp, Artificial sequence
  Synthetic oligonucleotide
atcagcacctgactgcgg

SEQ ID NO: 2070 - DNA, 18 bp, Artificial sequence
  Synthetic oligonucleotide
ttcagatcagcacctgac

SEQ ID NO: 2071 - DNA, 18 bp, Artificial sequence
  Synthetic oligonucleotide
gacttcagatcagcacct

SEQ ID NO: 2072 - DNA, 18 bp, Artificial sequence
  Synthetic oligonucleotide
aagacttcagatcagcac

SEQ ID NO: 2073 - DNA, 18 bp, Artificial sequence
  Synthetic oligonucleotide
aaagacttcagatcagca

SEQ ID NO: 2074 - DNA, 18 bp, Artificial sequence
  Synthetic oligonucleotide
caaagacttcagatcagc

SEQ ID NO: 2075 - DNA, 18 bp, Artificial sequence
  Synthetic oligonucleotide
ccaaagacttcagatcag

SEQ ID NO: 2076 - DNA, 18 bp, Artificial sequence
  Synthetic oligonucleotide
accaaagacttcagatca

SEQ ID NO: 2077 - DNA, 18 bp, Artificial sequence
  Synthetic oligonucleotide
caccaaagacttcagatc

SEQ ID NO: 2078 - DNA, 18 bp, Artificial sequence
  Synthetic oligonucleotide
ccaccaaagacttcagat

SEQ ID NO: 2079 - DNA, 18 bp, Artificial sequence
  Synthetic oligonucleotide
gcccaccaaagacttcag

SEQ ID NO: 2080 - DNA, 18 bp, Artificial sequence
  Synthetic oligonucleotide
tcagcccaccaaagactt

SEQ ID NO: 2081 - DNA, 18 bp, Artificial sequence
  Synthetic oligonucleotide
taaagtcagcccaccaaa

SEQ ID NO: 2082 - DNA, 18 bp, Artificial sequence
  Synthetic oligonucleotide
gttattgggactgacctt

SEQ ID NO: 2083 - DNA, 18 bp, Artificial sequence
  Synthetic oligonucleotide
gatttgttattgggactg

SEQ ID NO: 2084 - DNA, 18 bp, Artificial sequence
  Synthetic oligonucleotide
cagtggagccactcaacg

SEQ ID NO: 2085 - DNA, 18 bp, Artificial sequence
  Synthetic oligonucleotide
cacctgtccacagtggag

SEQ ID NO: 2086 - DNA, 18 bp, Artificial sequence
  Synthetic oligonucleotide
aacaaacgggtcacctgt

SEQ ID NO: 2087 - DNA, 18 bp, Artificial sequence
  Synthetic oligonucleotide
cgtgtaggagcagcagct

SEQ ID NO: 2088 - DNA, 18 bp, Artificial sequence
  Synthetic oligonucleotide
ctttggtttggctctttg

SEQ ID NO: 2089 - DNA, 18 bp, Artificial sequence
  Synthetic oligonucleotide
gctggtgggagaggagcc

SEQ ID NO: 2090 - DNA, 18 bp, Artificial sequence
  Synthetic oligonucleotide
atgcgggtggctgcctca

SEQ ID NO: 2091 - DNA, 18 bp, Artificial sequence
  Synthetic oligonucleotide
gctggatgcgggtggctg

SEQ ID NO: 2092 - DNA, 18 bp, Artificial sequence
  Synthetic oligonucleotide
gtgctcagggcaggaagc

SEQ ID NO: 2093 - DNA, 18 bp, Artificial sequence
  Synthetic oligonucleotide
caaagctcaaacagctga

SEQ ID NO: 2094 - DNA, 18 bp, Artificial sequence
  Synthetic oligonucleotide
agaaccaggatcaaagct

SEQ ID NO: 2095 - DNA, 18 bp, Artificial sequence
  Synthetic oligonucleotide
gctccgcctcagcagcac

SEQ ID NO: 2096 - DNA, 18 bp, Artificial sequence
  Synthetic oligonucleotide
gtgtgcactctctcccca

SEQ ID NO: 2097 - DNA, 18 bp, Artificial sequence
  Synthetic oligonucleotide
ggctagcccgcagacgag

SEQ ID NO: 2098 - DNA, 18 bp, Artificial sequence
  Synthetic oligonucleotide
cctgtgaaggtgctcaga

SEQ ID NO: 2099 - DNA, 18 bp, Artificial sequence
  Synthetic oligonucleotide
gatccagtgcccccagat

SEQ ID NO: 2100 - DNA, 18 bp, Artificial sequence
  Synthetic oligonucleotide
ggagaggctagggctcag

SEQ ID NO: 2101 - DNA, 18 bp, Artificial sequence
  Synthetic oligonucleotide
agaggagtggatggcagt

SEQ ID NO: 2102 - DNA, 18 bp, Artificial sequence
  Synthetic oligonucleotide
tggcctgggtgaggtaac

SEQ ID NO: 2103 - DNA, 18 bp, Artificial sequence
  Synthetic oligonucleotide
ctctggcctgggtgaggt

SEQ ID NO: 2104 - DNA, 18 bp, Artificial sequence
  Synthetic oligonucleotide
agggcaggtggtggtttc

SEQ ID NO: 2105 - DNA, 18 bp, Artificial sequence
  Synthetic oligonucleotide
gacattcctggagtcccc

SEQ ID NO: 2106 - DNA, 18 bp, Artificial sequence
  Synthetic oligonucleotide
tggcagacagacaggtcc

SEQ ID NO: 2107 - DNA, 18 bp, Artificial sequence
  Synthetic oligonucleotide
agtcaaagaaccagctcc

SEQ ID NO: 2108 - DNA, 18 bp, Artificial sequence
  Synthetic oligonucleotide
tccctctgggaatgatga

SEQ ID NO: 2109 - DNA, 18 bp, Artificial sequence
  Synthetic oligonucleotide
gcctccagggcaccgctc

SEQ ID NO: 2110 - DNA, 18 bp, Artificial sequence
  Synthetic oligonucleotide
gcctgtggcctccagggc

SEQ ID NO: 2111 - DNA, 18 bp, Artificial sequence
  Synthetic oligonucleotide
aggaggcctgtggcctcc

SEQ ID NO: 2112 - DNA, 18 bp, Artificial sequence
  Synthetic oligonucleotide
aataggaacaaagcaaca

SEQ ID NO: 2113 - DNA, 18 bp, Artificial sequence
  Synthetic oligonucleotide
ctgtctttagcaatagga

SEQ ID NO: 2114 - DNA, 18 bp, Artificial sequence
  Synthetic oligonucleotide
tgtcctggacattcctgt

SEQ ID NO: 2115 - DNA, 18 bp, Artificial sequence
  Synthetic oligonucleotide
tggaaaggcaggagtggg

SEQ ID NO: 2116 - DNA, 18 bp, Artificial sequence
  Synthetic oligonucleotide
tctgaaaaatcttgctgg

SEQ ID NO: 2117 - DNA, 18 bp, Artificial sequence
  Synthetic oligonucleotide
agcatctgaaaaatcttg

SEQ ID NO: 2118 - DNA, 18 bp, Artificial sequence
  Synthetic oligonucleotide
atgagtatgcacagcatc

SEQ ID NO: 2119 - DNA, 18 bp, Artificial sequence
  Synthetic oligonucleotide
aaagtgatcaatatgatg

SEQ ID NO: 2120 - DNA, 18 bp, Artificial sequence
  Synthetic oligonucleotide
gtcactccctttcctgac

SEQ ID NO: 2121 - DNA, 18 bp, Artificial sequence
  Synthetic oligonucleotide
acgcttaagtgtaaaaat

SEQ ID NO: 2122 - DNA, 18 bp, Artificial sequence
  Synthetic oligonucleotide
aaatgtgttgtcgaaatt

SEQ ID NO: 2123 - DNA, 18 bp, Artificial sequence
  Synthetic oligonucleotide
cagggtggaaaaatgtgt

SEQ ID NO: 2124 - DNA, 18 bp, Artificial sequence
  Synthetic oligonucleotide
ttcccagctgccatgagg

SEQ ID NO: 2125 - DNA, 18 bp, Artificial sequence
  Synthetic oligonucleotide
tggagatgagagaggagg

SEQ ID NO: 2126 - DNA, 18 bp, Artificial sequence
  Synthetic oligonucleotide
gcgcttacctgatagtcg

SEQ ID NO: 2127 - DNA, 18 bp, Artificial sequence
  Synthetic oligonucleotide
tccactaacctttcaggc

SEQ ID NO: 2128 - DNA, 18 bp, Artificial sequence
  Synthetic oligonucleotide
gggagattctggaacaca

SEQ ID NO: 2129 - DNA, 18 bp, Artificial sequence
  Synthetic oligonucleotide
gggcccaccttccgctgt

SEQ ID NO: 2130 - DNA, 18 bp, Artificial sequence
  Synthetic oligonucleotide
ctgtcacatctagaaacc

SEQ ID NO: 2131 - DNA, 18 bp, Artificial sequence
  Synthetic oligonucleotide
taccctcacctgtggttc

SEQ ID NO: 2132 - DNA, 18 bp, Artificial sequence
  Synthetic oligonucleotide
cttcttcagctggtgtat

SEQ ID NO: 2133 - DNA, 18 bp, Artificial sequence
  Synthetic oligonucleotide
ttcactgaccttgggtca

SEQ ID NO: 2134 - DNA, 18 bp, Artificial sequence
  Synthetic oligonucleotide
tttcaggctctgtgtgga

SEQ ID NO: 2135 - DNA, 18 bp, Artificial sequence
  Synthetic oligonucleotide
gacacagacctttgagtt

SEQ ID NO: 2136 - DNA, 18 bp, Artificial sequence
  Synthetic oligonucleotide
ccatgcgagctgataaaa

SEQ ID NO: 2137 - DNA, 18 bp, Artificial sequence
  Synthetic oligonucleotide
gtggatgtcttaaacata

SEQ ID NO: 2138 - DNA, 18 bp, Artificial sequence
  Synthetic oligonucleotide
tttccttaccttgagttt

SEQ ID NO: 2139 - DNA, 18 bp, Artificial sequence
  Synthetic oligonucleotide
atcagccccctgtaaatg

SEQ ID NO: 2140 - DNA, 18 bp, Artificial sequence
  Synthetic oligonucleotide
tcttcttaccagagctgg

SEQ ID NO: 2141 - DNA, 18 bp, Artificial sequence
  Synthetic oligonucleotide
gaggttcacctgggaagg

SEQ ID NO: 2142 - DNA, 18 bp, Artificial sequence
  Synthetic oligonucleotide
cactctcaccttcccgcc

SEQ ID NO: 2143 - DNA, 18 bp, Artificial sequence
  Synthetic oligonucleotide
cctccaggcgcagcccta

SEQ ID NO: 2144 - DNA, 18 bp, Artificial sequence
  Synthetic oligonucleotide
cctgaggagggcactcac

SEQ ID NO: 2145 - DNA, 18 bp, Artificial sequence
  Synthetic oligonucleotide
ggaaccgctgtgggtgcc

SEQ ID NO: 2146 - DNA, 18 bp, Artificial sequence
  Synthetic oligonucleotide
tgggtggcagtgtattct

SEQ ID NO: 2147 - DNA, 18 bp, Artificial sequence
  Synthetic oligonucleotide
ggagagctcgcgagcacc

SEQ ID NO: 2148 - DNA, 18 bp, Artificial sequence
  Synthetic oligonucleotide
gaggtggctacccacggc

SEQ ID NO: 2149 - DNA, 18 bp, Artificial sequence
  Synthetic oligonucleotide
ccagaaggcccagcacat

SEQ ID NO: 2150 - DNA, 18 bp, Artificial sequence
  Synthetic oligonucleotide
cgaggcccagtgcccaga

SEQ ID NO: 2151 - DNA, 18 bp, Artificial sequence
  Synthetic oligonucleotide
aggcccagggttccagaa

SEQ ID NO: 2152 - DNA, 18 bp, Artificial sequence
  Synthetic oligonucleotide
aggcaagctgacacgcag

SEQ ID NO: 2153 - DNA, 18 bp, Artificial sequence
  Synthetic oligonucleotide
caggaaaaggccggacct

SEQ ID NO: 2154 - DNA, 18 bp, Artificial sequence
  Synthetic oligonucleotide
agcaggaaaaggccggac

SEQ ID NO: 2155 - DNA, 18 bp, Artificial sequence
  Synthetic oligonucleotide
ttccccaaggtctctaac

SEQ ID NO: 2156 - DNA, 18 bp, Artificial sequence
  Synthetic oligonucleotide
aggaaaggccagtgaggg

SEQ ID NO: 2157 - DNA, 18 bp, Artificial sequence
  Synthetic oligonucleotide
ttgttatgtgacttgagg

SEQ ID NO: 2158 - DNA, 18 bp, Artificial sequence
  Synthetic oligonucleotide
attccccaccatgggaca

SEQ ID NO: 2159 - DNA, 18 bp, Artificial sequence
  Synthetic oligonucleotide
aggacattccccaccatg

SEQ ID NO: 2160 - DNA, 18 bp, Artificial sequence
  Synthetic oligonucleotide
agataaggagagaaggac

SEQ ID NO: 2161 - DNA, 18 bp, Artificial sequence
  Synthetic oligonucleotide
atgctcagtgtggtcaga

SEQ ID NO: 2162 - DNA, 18 bp, Artificial sequence
  Synthetic oligonucleotide
agggccggccacctgcac

SEQ ID NO: 2163 - DNA, 18 bp, Artificial sequence
  Synthetic oligonucleotide
tctgtctctggcaacctg

SEQ ID NO: 2164 - DNA, 18 bp, Artificial sequence
  Synthetic oligonucleotide
aacagggaagctacttcc

SEQ ID NO: 2165 - DNA, 18 bp, Artificial sequence
  Synthetic oligonucleotide
gggccttcaatggaaagt

SEQ ID NO: 2166 - DNA, 18 bp, Artificial sequence
  Synthetic oligonucleotide
ggtcgcctgactctcacc

SEQ ID NO: 2167 - DNA, 18 bp, Artificial sequence
  Synthetic oligonucleotide
ccctttctacacttggca

SEQ ID NO: 2168 - DNA, 18 bp, Artificial sequence
  Synthetic oligonucleotide
tatctgcacctttggtag

SEQ ID NO: 2169 - DNA, 18 bp, Artificial sequence
  Synthetic oligonucleotide
tcttattaattatctgca

SEQ ID NO: 2170 - DNA, 18 bp, Artificial sequence
  Synthetic oligonucleotide
ttcttattaattatctgc

SEQ ID NO: 2171 - DNA, 18 bp, Artificial sequence
  Synthetic oligonucleotide
agcttcttattaattatc

SEQ ID NO: 2172 - DNA, 18 bp, Artificial sequence
  Synthetic oligonucleotide
cagcttcttattaattat

SEQ ID NO: 2173 - DNA, 18 bp, Artificial sequence
  Synthetic oligonucleotide
tccagcttcttattaatt

SEQ ID NO: 2174 - DNA, 18 bp, Artificial sequence
  Synthetic oligonucleotide
atccagcttcttattaat

SEQ ID NO: 2175 - DNA, 18 bp, Artificial sequence
  Synthetic oligonucleotide
agatccagcttcttatta

SEQ ID NO: 2176 - DNA, 18 bp, Artificial sequence
  Synthetic oligonucleotide
aagatccagcttcttatt

SEQ ID NO: 2177 - DNA, 18 bp, Artificial sequence
  Synthetic oligonucleotide
ctaagatccagcttctta

SEQ ID NO: 2178 - DNA, 18 bp, Artificial sequence
  Synthetic oligonucleotide
gctaagatccagcttctt

SEQ ID NO: 2179 - DNA, 18 bp, Artificial sequence
  Synthetic oligonucleotide
ttgctaagatccagcttc

SEQ ID NO: 2180 - DNA, 18 bp, Artificial sequence
  Synthetic oligonucleotide
gttgctaagatccagctt

SEQ ID NO: 2181 - DNA, 18 bp, Artificial sequence
  Synthetic oligonucleotide
gccacacttggactggac

SEQ ID NO: 2182 - DNA, 18 bp, Artificial sequence
  Synthetic oligonucleotide
agccacacttggactgga

SEQ ID NO: 2183 - DNA, 18 bp, Artificial sequence
  Synthetic oligonucleotide
tgagccacacttggactg

SEQ ID NO: 2184 - DNA, 18 bp, Artificial sequence
  Synthetic oligonucleotide
ttgagccacacttggact

SEQ ID NO: 2185 - DNA, 18 bp, Artificial sequence
  Synthetic oligonucleotide
cctttgagccacacttgg

SEQ ID NO: 2186 - DNA, 18 bp, Artificial sequence
  Synthetic oligonucleotide
atcctttgagccacactt

SEQ ID NO: 2187 - DNA, 18 bp, Artificial sequence
  Synthetic oligonucleotide
tatcctttgagccacact

SEQ ID NO: 2188 - DNA, 18 bp, Artificial sequence
  Synthetic oligonucleotide
attatcctttgagccaca

SEQ ID NO: 2189 - DNA, 18 bp, Artificial sequence
  Synthetic oligonucleotide
tattatcctttgagccac

SEQ ID NO: 2190 - DNA, 18 bp, Artificial sequence
  Synthetic oligonucleotide
gatattatcctttgagcc

SEQ ID NO: 2191 - DNA, 18 bp, Artificial sequence
  Synthetic oligonucleotide
tgatattatcctttgagc

SEQ ID NO: 2192 - DNA, 18 bp, Artificial sequence
  Synthetic oligonucleotide
gtttgatattatcctttg

SEQ ID NO: 2193 - DNA, 18 bp, Artificial sequence
  Synthetic oligonucleotide
gtgtttgatattatcctt

SEQ ID NO: 2194 - DNA, 18 bp, Artificial sequence
  Synthetic oligonucleotide
cgtgtttgatattatcct

SEQ ID NO: 2195 - DNA, 18 bp, Artificial sequence
  Synthetic oligonucleotide
actgccgcctcccgggac

SEQ ID NO: 2196 - DNA, 18 bp, Artificial sequence
  Synthetic oligonucleotide
tatttgcacctggagatg

SEQ ID NO: 2197 - DNA, 18 bp, Artificial sequence
  Synthetic oligonucleotide
cagggctacctggtttat

SEQ ID NO: 2198 - DNA, 18 bp, Artificial sequence
  Synthetic oligonucleotide
ggccacctcctagaacac

SEQ ID NO: 2199 - DNA, 18 bp, Artificial sequence
  Synthetic oligonucleotide
cccctttacctttttatt

SEQ ID NO: 2200 - DNA, 18 bp, Artificial sequence
  Synthetic oligonucleotide
ggtttcaatctgcaagaa

SEQ ID NO: 2201 - DNA, 18 bp, Artificial sequence
  Synthetic oligonucleotide
ttcgatttgttattggga

SEQ ID NO: 2202 - DNA, 18 bp, Artificial sequence
  Synthetic oligonucleotide
acttcgatttgttattgg

SEQ ID NO: 2203 - DNA, 18 bp, Artificial sequence
  Synthetic oligonucleotide
gacttcgatttgttattg

SEQ ID NO: 2204 - DNA, 18 bp, Artificial sequence
  Synthetic oligonucleotide
tgacttcgatttgttatt

SEQ ID NO: 2205 - DNA, 18 bp, Artificial sequence
  Synthetic oligonucleotide
ctgacttcgatttgttat

SEQ ID NO: 2206 - DNA, 18 bp, Artificial sequence
  Synthetic oligonucleotide
gctgacttcgatttgtta

SEQ ID NO: 2207 - DNA, 18 bp, Artificial sequence
  Synthetic oligonucleotide
agctgacttcgatttgtt

SEQ ID NO: 2208 - DNA, 18 bp, Artificial sequence
  Synthetic oligonucleotide
cagctgacttcgatttgt

SEQ ID NO: 2209 - DNA, 18 bp, Artificial sequence
  Synthetic oligonucleotide
cccagctgacttcgattt

SEQ ID NO: 2210 - DNA, 18 bp, Artificial sequence
  Synthetic oligonucleotide
acgcccagctgacttcga

SEQ ID NO: 2211 - DNA, 18 bp, Artificial sequence
  Synthetic oligonucleotide
tgccttatatatgctgaa

SEQ ID NO: 2212 - DNA, 18 bp, Artificial sequence
  Synthetic oligonucleotide
ttacatgccttatatatg

SEQ ID NO: 2213 - DNA, 18 bp, Artificial sequence
  Synthetic oligonucleotide
cagttacatgccttatat

SEQ ID NO: 2214 - DNA, 18 bp, Artificial sequence
  Synthetic oligonucleotide
ttcagttacatgccttat

SEQ ID NO: 2215 - DNA, 18 bp, Artificial sequence
  Synthetic oligonucleotide
gttcagttacatgcctta

SEQ ID NO: 2216 - DNA, 18 bp, Artificial sequence
  Synthetic oligonucleotide
aaagtgctgtgttcagtt

SEQ ID NO: 2217 - DNA, 18 bp, Artificial sequence
  Synthetic oligonucleotide
cctctaaagtgctgtgtt

SEQ ID NO: 2218 - DNA, 18 bp, Artificial sequence
  Synthetic oligonucleotide
gacttttctcaatgtaac

SEQ ID NO: 2219 - DNA, 18 bp, Artificial sequence
  Synthetic oligonucleotide
ctgcagacttttctcaat

SEQ ID NO: 2220 - DNA, 18 bp, Artificial sequence
  Synthetic oligonucleotide
acctctctgcagactttt

SEQ ID NO: 2221 - DNA, 18 bp, Artificial sequence
  Synthetic oligonucleotide
cacctctctgcagacttt

SEQ ID NO: 2222 - DNA, 18 bp, Artificial sequence
  Synthetic oligonucleotide
gcacctctctgcagactt

SEQ ID NO: 2223 - DNA, 18 bp, Artificial sequence
  Synthetic oligonucleotide
ggcacctctctgcagact

SEQ ID NO: 2224 - DNA, 18 bp, Artificial sequence
  Synthetic oligonucleotide
tggcacctctctgcagac

SEQ ID NO: 2225 - DNA, 18 bp, Artificial sequence
  Synthetic oligonucleotide
ctggcacctctctgcaga

SEQ ID NO: 2226 - DNA, 18 bp, Artificial sequence
  Synthetic oligonucleotide
tgctggcacctctctgca

SEQ ID NO: 2227 - DNA, 18 bp, Artificial sequence
  Synthetic oligonucleotide
tgatgctggcacctctct

SEQ ID NO: 2228 - DNA, 18 bp, Artificial sequence
  Synthetic oligonucleotide
ccttgtgatgctggcacc

SEQ ID NO: 2229 - DNA, 18 bp, Artificial sequence
  Synthetic oligonucleotide
tttttagcattaaaagag

SEQ ID NO: 2230 - DNA, 18 bp, Artificial sequence
  Synthetic oligonucleotide
gtgttttcttatttttag

SEQ ID NO: 2231 - DNA, 18 bp, Artificial sequence
  Synthetic oligonucleotide
gcaaggtgttttcttatt

SEQ ID NO: 2232 - DNA, 18 bp, Artificial sequence
  Synthetic oligonucleotide
taggcctcttctgcattt

SEQ ID NO: 2233 - DNA, 18 bp, Artificial sequence
  Synthetic oligonucleotide
ctggctaggcctcttctg

SEQ ID NO: 2234 - DNA, 18 bp, Artificial sequence
  Synthetic oligonucleotide
atcctggctaggcctctt

SEQ ID NO: 2235 - DNA, 18 bp, Artificial sequence
  Synthetic oligonucleotide
aaatcctggctaggcctc

SEQ ID NO: 2236 - DNA, 18 bp, Artificial sequence
  Synthetic oligonucleotide
gaaatcctggctaggcct

SEQ ID NO: 2237 - DNA, 18 bp, Artificial sequence
  Synthetic oligonucleotide
tgaaatcctggctaggcc

SEQ ID NO: 2238 - DNA, 18 bp, Artificial sequence
  Synthetic oligonucleotide
gtgaaatcctggctaggc

SEQ ID NO: 2239 - DNA, 18 bp, Artificial sequence
  Synthetic oligonucleotide
ggtgaaatcctggctagg

SEQ ID NO: 2240 - DNA, 18 bp, Artificial sequence
  Synthetic oligonucleotide
tggtgaaatcctggctag

SEQ ID NO: 2241 - DNA, 18 bp, Artificial sequence
  Synthetic oligonucleotide
ctggtgaaatcctggcta

SEQ ID NO: 2242 - DNA, 18 bp, Artificial sequence
  Synthetic oligonucleotide
tgctggtgaaatcctggc

SEQ ID NO: 2243 - DNA, 18 bp, Artificial sequence
  Synthetic oligonucleotide
cactgctggtgaaatcct

SEQ ID NO: 2244 - DNA, 18 bp, Artificial sequence
  Synthetic oligonucleotide
accctggacccgcctact

SEQ ID NO: 2245 - DNA, 18 bp, Artificial sequence
  Synthetic oligonucleotide
gcgccaccctggacccgc

SEQ ID NO: 2246 - DNA, 18 bp, Artificial sequence
  Synthetic oligonucleotide
catgcgccaccctggacc

SEQ ID NO: 2247 - DNA, 18 bp, Artificial sequence
  Synthetic oligonucleotide
gacatgcgccaccctgga

SEQ ID NO: 2248 - DNA, 18 bp, Artificial sequence
  Synthetic oligonucleotide
tgacatgcgccaccctgg

SEQ ID NO: 2249 - DNA, 18 bp, Artificial sequence
  Synthetic oligonucleotide
gtgacatgcgccaccctg

SEQ ID NO: 2250 - DNA, 18 bp, Artificial sequence
  Synthetic oligonucleotide
agtgacatgcgccaccct

SEQ ID NO: 2251 - DNA, 18 bp, Artificial sequence
  Synthetic oligonucleotide
gagtgacatgcgccaccc

SEQ ID NO: 2252 - DNA, 18 bp, Artificial sequence
  Synthetic oligonucleotide
tgagtgacatgcgccacc

SEQ ID NO: 2253 - DNA, 18 bp, Artificial sequence
  Synthetic oligonucleotide
atgagtgacatgcgccac

SEQ ID NO: 2254 - DNA, 18 bp, Artificial sequence
  Synthetic oligonucleotide
cgatgagtgacatgcgcc

SEQ ID NO: 2255 - DNA, 18 bp, Artificial sequence
  Synthetic oligonucleotide
tttcgatgagtgacatgc

SEQ ID NO: 2256 - DNA, 18 bp, Artificial sequence
  Synthetic oligonucleotide
tccactttcgatgagtga

SEQ ID NO: 2257 - DNA, 18 bp, Artificial sequence
  Synthetic oligonucleotide
cagcacggcgcatgggac

SEQ ID NO: 2258 - DNA, 18 bp, Artificial sequence
  Synthetic oligonucleotide
acagcacggcgcatggga

SEQ ID NO: 2259 - DNA, 18 bp, Artificial sequence
  Synthetic oligonucleotide
cacagcacggcgcatggg

SEQ ID NO: 2260 - DNA, 18 bp, Artificial sequence
  Synthetic oligonucleotide
agccacagcacggcgcat

SEQ ID NO: 2261 - DNA, 18 bp, Artificial sequence
  Synthetic oligonucleotide
aagccacagcacggcgca

SEQ ID NO: 2262 - DNA, 18 bp, Artificial sequence
  Synthetic oligonucleotide
tcaagccacagcacggcg

SEQ ID NO: 2263 - DNA, 18 bp, Artificial sequence
  Synthetic oligonucleotide
aattcaagccacagcacg

SEQ ID NO: 2264 - DNA, 18 bp, Artificial sequence
  Synthetic oligonucleotide
ctaataattcaagccaca

SEQ ID NO: 2265 - DNA, 18 bp, Artificial sequence
  Synthetic oligonucleotide
gacatttgctcagcaaac

SEQ ID NO: 2266 - DNA, 18 bp, Artificial sequence
  Synthetic oligonucleotide
cagacatttgctcagcaa

SEQ ID NO: 2267 - DNA, 18 bp, Artificial sequence
  Synthetic oligonucleotide
ccagacatttgctcagca

SEQ ID NO: 2268 - DNA, 18 bp, Artificial sequence
  Synthetic oligonucleotide
cccagacatttgctcagc

SEQ ID NO: 2269 - DNA, 18 bp, Artificial sequence
  Synthetic oligonucleotide
acccagacatttgctcag

SEQ ID NO: 2270 - DNA, 18 bp, Artificial sequence
  Synthetic oligonucleotide
gacccagacatttgctca

SEQ ID NO: 2271 - DNA, 18 bp, Artificial sequence
  Synthetic oligonucleotide
agacccagacatttgctc

SEQ ID NO: 2272 - DNA, 18 bp, Artificial sequence
  Synthetic oligonucleotide
aagacccagacatttgct

SEQ ID NO: 2273 - DNA, 18 bp, Artificial sequence
  Synthetic oligonucleotide
gcaagacccagacatttg

SEQ ID NO: 2274 - DNA, 18 bp, Artificial sequence
  Synthetic oligonucleotide
tgtgcaagacccagacat

SEQ ID NO: 2275 - DNA, 18 bp, Artificial sequence
  Synthetic oligonucleotide
gtcattgtgcaagaccca

SEQ ID NO: 2276 - DNA, 18 bp, Artificial sequence
  Synthetic oligonucleotide
tcttccatcacttcgaac

SEQ ID NO: 2277 - DNA, 18 bp, Artificial sequence
  Synthetic oligonucleotide
atcttccatcacttcgaa

SEQ ID NO: 2278 - DNA, 18 bp, Artificial sequence
  Synthetic oligonucleotide
tgatcttccatcacttcg

SEQ ID NO: 2279 - DNA, 18 bp, Artificial sequence
  Synthetic oligonucleotide
gtgatcttccatcacttc

SEQ ID NO: 2280 - DNA, 18 bp, Artificial sequence
  Synthetic oligonucleotide
atggtgtagcccccctga

SEQ ID NO: 2281 - DNA, 18 bp, Artificial sequence
  Synthetic oligonucleotide
catggtgtagcccccctg

SEQ ID NO: 2282 - DNA, 18 bp, Artificial sequence
  Synthetic oligonucleotide
tgcatggtgtagcccccc

SEQ ID NO: 2283 - DNA, 18 bp, Artificial sequence
  Synthetic oligonucleotide
gtgcatggtgtagccccc

SEQ ID NO: 2284 - DNA, 18 bp, Artificial sequence
  Synthetic oligonucleotide
ccgtgtcaccctcttggt

SEQ ID NO: 2285 - DNA, 18 bp, Artificial sequence
  Synthetic oligonucleotide
tccgtgtcaccctcttgg

SEQ ID NO: 2286 - DNA, 18 bp, Artificial sequence
  Synthetic oligonucleotide
cgtccgtgtcaccctctt

SEQ ID NO: 2287 - DNA, 18 bp, Artificial sequence
  Synthetic oligonucleotide
tcttagcatcagaggttt

SEQ ID NO: 2288 - DNA, 18 bp, Artificial sequence
  Synthetic oligonucleotide
ctcttagcatcagaggtt

SEQ ID NO: 2289 - DNA, 18 bp, Artificial sequence
  Synthetic oligonucleotide
tgctcttagcatcagagg

SEQ ID NO: 2290 - DNA, 18 bp, Artificial sequence
  Synthetic oligonucleotide
gtgctcttagcatcagag

SEQ ID NO: 2291 - DNA, 18 bp, Artificial sequence
  Synthetic oligonucleotide
ctcctccgagtgcgcctg

SEQ ID NO: 2292 - DNA, 18 bp, Artificial sequence
  Synthetic oligonucleotide
gctcctccgagtgcgcct

SEQ ID NO: 2293 - DNA, 18 bp, Artificial sequence
  Synthetic oligonucleotide
atgctcctccgagtgcgc

SEQ ID NO: 2294 - DNA, 18 bp, Artificial sequence
  Synthetic oligonucleotide
aatgctcctccgagtgcg

SEQ ID NO: 2295 - DNA, 18 bp, Artificial sequence
  Synthetic oligonucleotide
caaatgctcctccgagtg

SEQ ID NO: 2296 - DNA, 18 bp, Artificial sequence
  Synthetic oligonucleotide
ttactgaccatgcgagct

SEQ ID NO: 2297 - DNA, 18 bp, Artificial sequence
  Synthetic oligonucleotide
tttactgaccatgcgagc

SEQ ID NO: 2298 - DNA, 18 bp, Artificial sequence
  Synthetic oligonucleotide
cttttactgaccatgcga

SEQ ID NO: 2299 - DNA, 18 bp, Artificial sequence
  Synthetic oligonucleotide
gcttttactgaccatgcg

SEQ ID NO: 2300 - DNA, 18 bp, Artificial sequence
  Synthetic oligonucleotide
ttgcttttactgaccatg

SEQ ID NO: 2301 - DNA, 18 bp, Artificial sequence
  Synthetic oligonucleotide
actgcgaggagcagctgg

SEQ ID NO: 2302 - DNA, 18 bp, Artificial sequence
  Synthetic oligonucleotide
aactgcgaggagcagctg

SEQ ID NO: 2303 - DNA, 18 bp, Artificial sequence
  Synthetic oligonucleotide
cgaactgcgaggagcagc

SEQ ID NO: 2304 - DNA, 18 bp, Artificial sequence
  Synthetic oligonucleotide
ccgaactgcgaggagcag

SEQ ID NO: 2305 - DNA, 18 bp, Artificial sequence
  Synthetic oligonucleotide
aaccgaactgcgaggagc

SEQ ID NO: 2306 - DNA, 18 bp, Artificial sequence
  Synthetic oligonucleotide
tgctcttactcccatcac

SEQ ID NO: 2307 - DNA, 18 bp, Artificial sequence
  Synthetic oligonucleotide
ttgctcttactcccatca

SEQ ID NO: 2308 - DNA, 18 bp, Artificial sequence
  Synthetic oligonucleotide
atttgctcttactcccat

SEQ ID NO: 2309 - DNA, 18 bp, Artificial sequence
  Synthetic oligonucleotide
aatttgctcttactccca

SEQ ID NO: 2310 - DNA, 18 bp, Artificial sequence
  Synthetic oligonucleotide
accttcatttactgtcag

SEQ ID NO: 2311 - DNA, 18 bp, Artificial sequence
  Synthetic oligonucleotide
caccttcatttactgtca

SEQ ID NO: 2312 - DNA, 18 bp, Artificial sequence
  Synthetic oligonucleotide
cacaccttcatttactgt

SEQ ID NO: 2313 - DNA, 18 bp, Artificial sequence
  Synthetic oligonucleotide
acacaccttcatttactg

SEQ ID NO: 2314 - DNA, 18 bp, Artificial sequence
  Synthetic oligonucleotide
aacacaccttcatttact

SEQ ID NO: 2315 - DNA, 18 bp, Artificial sequence
  Synthetic oligonucleotide
aaacacaccttcatttac

SEQ ID NO: 2316 - DNA, 18 bp, Artificial sequence
  Synthetic oligonucleotide
caaacacaccttcattta

SEQ ID NO: 2317 - DNA, 18 bp, Artificial sequence
  Synthetic oligonucleotide
tcaaacacaccttcattt

SEQ ID NO: 2318 - DNA, 18 bp, Artificial sequence
  Synthetic oligonucleotide
ttcaaacacaccttcatt

SEQ ID NO: 2319 - DNA, 18 bp, Artificial sequence
  Synthetic oligonucleotide
tttcaaacacaccttcat

SEQ ID NO: 2320 - DNA, 18 bp, Artificial sequence
  Synthetic oligonucleotide
ttggttttcaaacacacc

SEQ ID NO: 2321 - DNA, 18 bp, Artificial sequence
  Synthetic oligonucleotide
agcattaaaagagaaaag

SEQ ID NO: 2322 - DNA, 18 bp, Artificial sequence
  Synthetic oligonucleotide
ttatttttagcattaaaa

SEQ ID NO: 2323 - DNA, 18 bp, Artificial sequence
  Synthetic oligonucleotide
tcttatttttagcattaa

SEQ ID NO: 2324 - DNA, 18 bp, Artificial sequence
  Synthetic oligonucleotide
ttcttatttttagcatta

SEQ ID NO: 2325 - DNA, 18 bp, Artificial sequence
  Synthetic oligonucleotide
tttcttatttttagcatt

SEQ ID NO: 2326 - DNA, 18 bp, Artificial sequence
  Synthetic oligonucleotide
ttttcttatttttagcat

SEQ ID NO: 2327 - DNA, 18 bp, Artificial sequence
  Synthetic oligonucleotide
gttttcttatttttagca

SEQ ID NO: 2328 - DNA, 18 bp, Artificial sequence
  Synthetic oligonucleotide
tgttttcttatttttagc

SEQ ID NO: 2329 - DNA, 18 bp, Artificial sequence
  Synthetic oligonucleotide
aggtgttttcttattttt

SEQ ID NO: 2330 - DNA, 18 bp, Artificial sequence
  Synthetic oligonucleotide
gggctgcaaggtgttttc

SEQ ID NO: 2331 - DNA, 18 bp, Artificial sequence
  Synthetic oligonucleotide
gacaaaagcaggttaagt

SEQ ID NO: 2332 - DNA, 19 bp, Artificial sequence
  Synthetic oligonucleotide
tgacaaaagcaggttaagt

SEQ ID NO: 2333 - DNA, 20 bp, Artificial sequence
  Synthetic oligonucleotide
gtgacaaaagcaggttaagt

SEQ ID NO: 2334 - DNA, 18 bp, Artificial sequence
  Synthetic oligonucleotide
tgacaaaagcaggttaag

SEQ ID NO: 2335 - DNA, 19 bp, Artificial sequence
  Synthetic oligonucleotide
gtgacaaaagcaggttaag

SEQ ID NO: 2336 - DNA, 20 bp, Artificial sequence
  Synthetic oligonucleotide
agtgacaaaagcaggttaag

SEQ ID NO: 2337 - DNA, 19 bp, Artificial sequence
  Synthetic oligonucleotide
agtgacaaaagcaggttaa

SEQ ID NO: 2338 - DNA, 20 bp, Artificial sequence
  Synthetic oligonucleotide
gagtgacaaaagcaggttaa

SEQ ID NO: 2339 - DNA, 18 bp, Artificial sequence
  Synthetic oligonucleotide
agtgacaaaagcaggtta

SEQ ID NO: 2340 - DNA, 19 bp, Artificial sequence
  Synthetic oligonucleotide
gagtgacaaaagcaggtta

SEQ ID NO: 2341 - DNA, 20 bp, Artificial sequence
  Synthetic oligonucleotide
cgagtgacaaaagcaggtta

SEQ ID NO: 2342 - DNA, 18 bp, Artificial sequence
  Synthetic oligonucleotide
gagtgacaaaagcaggtt

SEQ ID NO: 2343 - DNA, 19 bp, Artificial sequence
  Synthetic oligonucleotide
cgagtgacaaaagcaggtt

SEQ ID NO: 2344 - DNA, 20 bp, Artificial sequence
  Synthetic oligonucleotide
ccgagtgacaaaagcaggtt

SEQ ID NO: 2345 - DNA, 19 bp, Artificial sequence
  Synthetic oligonucleotide
ccgagtgacaaaagcaggt

SEQ ID NO: 2346 - DNA, 20 bp, Artificial sequence
  Synthetic oligonucleotide
gccgagtgacaaaagcaggt

SEQ ID NO: 2347 - DNA, 18 bp, Artificial sequence
  Synthetic oligonucleotide
ccgagtgacaaaagcagg

SEQ ID NO: 2348 - DNA, 19 bp, Artificial sequence
  Synthetic oligonucleotide
gccgagtgacaaaagcagg

SEQ ID NO: 2349 - DNA, 20 bp, Artificial sequence
  Synthetic oligonucleotide
agccgagtgacaaaagcagg

SEQ ID NO: 2350 - DNA, 18 bp, Artificial sequence
  Synthetic oligonucleotide
gccgagtgacaaaagcag

SEQ ID NO: 2351 - DNA, 19 bp, Artificial sequence
  Synthetic oligonucleotide
agccgagtgacaaaagcag

SEQ ID NO: 2352 - DNA, 20 bp, Artificial sequence
  Synthetic oligonucleotide
aagccgagtgacaaaagcag

SEQ ID NO: 2353 - DNA, 19 bp, Artificial sequence
  Synthetic oligonucleotide
aagccgagtgacaaaagca

SEQ ID NO: 2354 - DNA, 20 bp, Artificial sequence
  Synthetic oligonucleotide
aaagccgagtgacaaaagca

SEQ ID NO: 2355 - DNA, 18 bp, Artificial sequence
  Synthetic oligonucleotide
aagccgagtgacaaaagc

SEQ ID NO: 2356 - DNA, 19 bp, Artificial sequence
  Synthetic oligonucleotide
aaagccgagtgacaaaagc

SEQ ID NO: 2357 - DNA, 20 bp, Artificial sequence
  Synthetic oligonucleotide
caaagccgagtgacaaaagc

SEQ ID NO: 2358 - DNA, 18 bp, Artificial sequence
  Synthetic oligonucleotide
aaagccgagtgacaaaag

SEQ ID NO: 2359 - DNA, 19 bp, Artificial sequence
  Synthetic oligonucleotide
caaagccgagtgacaaaag

SEQ ID NO: 2360 - DNA, 20 bp, Artificial sequence
  Synthetic oligonucleotide
ccaaagccgagtgacaaaag

SEQ ID NO: 2361 - DNA, 19 bp, Artificial sequence
  Synthetic oligonucleotide
ccaaagccgagtgacaaaa

SEQ ID NO: 2362 - DNA, 20 bp, Artificial sequence
  Synthetic oligonucleotide
gccaaagccgagtgacaaaa

SEQ ID NO: 2363 - DNA, 18 bp, Artificial sequence
  Synthetic oligonucleotide
ccaaagccgagtgacaaa

SEQ ID NO: 2364 - DNA, 19 bp, Artificial sequence
  Synthetic oligonucleotide
gccaaagccgagtgacaaa

SEQ ID NO: 2365 - DNA, 20 bp, Artificial sequence
  Synthetic oligonucleotide
agccaaagccgagtgacaaa

SEQ ID NO: 2366 - DNA, 18 bp, Artificial sequence
  Synthetic oligonucleotide
gccaaagccgagtgacaa

SEQ ID NO: 2367 - DNA, 19 bp, Artificial sequence
  Synthetic oligonucleotide
agccaaagccgagtgacaa

SEQ ID NO: 2368 - DNA, 20 bp, Artificial sequence
  Synthetic oligonucleotide
gagccaaagccgagtgacaa

SEQ ID NO: 2369 - DNA, 19 bp, Artificial sequence
  Synthetic oligonucleotide
gagccaaagccgagtgaca

SEQ ID NO: 2370 - DNA, 18 bp, Artificial sequence
  Synthetic oligonucleotide
cactgattttgaagtccc

SEQ ID NO: 2371 - DNA, 19 bp, Artificial sequence
  Synthetic oligonucleotide
tcactgattttgaagtccc

SEQ ID NO: 2372 - DNA, 18 bp, Artificial sequence
  Synthetic oligonucleotide
tcactgattttgaagtcc

SEQ ID NO: 2373 - DNA, 19 bp, Artificial sequence
  Synthetic oligonucleotide
atcactgattttgaagtcc

SEQ ID NO: 2374 - DNA, 20 bp, Artificial sequence
  Synthetic oligonucleotide
catcactgattttgaagtcc

SEQ ID NO: 2375 - DNA, 19 bp, Artificial sequence
  Synthetic oligonucleotide
catcactgattttgaagtc

SEQ ID NO: 2376 - DNA, 20 bp, Artificial sequence
  Synthetic oligonucleotide
ccatcactgattttgaagtc

SEQ ID NO: 2377 - DNA, 18 bp, Artificial sequence
  Synthetic oligonucleotide
catcactgattttgaagt

SEQ ID NO: 2378 - DNA, 19 bp, Artificial sequence
  Synthetic oligonucleotide
ccatcactgattttgaagt

SEQ ID NO: 2379 - DNA, 20 bp, Artificial sequence
  Synthetic oligonucleotide
cccatcactgattttgaagt

SEQ ID NO: 2380 - DNA, 18 bp, Artificial sequence
  Synthetic oligonucleotide
ccatcactgattttgaag

SEQ ID NO: 2381 - DNA, 19 bp, Artificial sequence
  Synthetic oligonucleotide
cccatcactgattttgaag

SEQ ID NO: 2382 - DNA, 20 bp, Artificial sequence
  Synthetic oligonucleotide
tcccatcactgattttgaag

SEQ ID NO: 2383 - DNA, 19 bp, Artificial sequence
  Synthetic oligonucleotide
tcccatcactgattttgaa

SEQ ID NO: 2384 - DNA, 20 bp, Artificial sequence
  Synthetic oligonucleotide
ctcccatcactgattttgaa

SEQ ID NO: 2385 - DNA, 18 bp, Artificial sequence
  Synthetic oligonucleotide
tcccatcactgattttga

SEQ ID NO: 2386 - DNA, 19 bp, Artificial sequence
  Synthetic oligonucleotide
ctcccatcactgattttga

SEQ ID NO: 2387 - DNA, 20 bp, Artificial sequence
  Synthetic oligonucleotide
actcccatcactgattttga

SEQ ID NO: 2388 - DNA, 18 bp, Artificial sequence
  Synthetic oligonucleotide
ctcccatcactgattttg

SEQ ID NO: 2389 - DNA, 19 bp, Artificial sequence
  Synthetic oligonucleotide
actcccatcactgattttg

SEQ ID NO: 2390 - DNA, 20 bp, Artificial sequence
  Synthetic oligonucleotide
tactcccatcactgattttg

SEQ ID NO: 2391 - DNA, 19 bp, Artificial sequence
  Synthetic oligonucleotide
tactcccatcactgatttt

SEQ ID NO: 2392 - DNA, 20 bp, Artificial sequence
  Synthetic oligonucleotide
ttactcccatcactgatttt

SEQ ID NO: 2393 - DNA, 18 bp, Artificial sequence
  Synthetic oligonucleotide
tactcccatcactgattt

SEQ ID NO: 2394 - DNA, 19 bp, Artificial sequence
  Synthetic oligonucleotide
ttactcccatcactgattt

SEQ ID NO: 2395 - DNA, 20 bp, Artificial sequence
  Synthetic oligonucleotide
cttactcccatcactgattt

SEQ ID NO: 2396 - DNA, 18 bp, Artificial sequence
  Synthetic oligonucleotide
ttactcccatcactgatt

SEQ ID NO: 2397 - DNA, 19 bp, Artificial sequence
  Synthetic oligonucleotide
cttactcccatcactgatt

SEQ ID NO: 2398 - DNA, 20 bp, Artificial sequence
  Synthetic oligonucleotide
tcttactcccatcactgatt

SEQ ID NO: 2399 - DNA, 19 bp, Artificial sequence
  Synthetic oligonucleotide
tcttactcccatcactgat

SEQ ID NO: 2400 - DNA, 20 bp, Artificial sequence
  Synthetic oligonucleotide
ctcttactcccatcactgat

SEQ ID NO: 2401 - DNA, 18 bp, Artificial sequence
  Synthetic oligonucleotide
tcttactcccatcactga

SEQ ID NO: 2402 - DNA, 19 bp, Artificial sequence
  Synthetic oligonucleotide
ctcttactcccatcactga

SEQ ID NO: 2403 - DNA, 20 bp, Artificial sequence
  Synthetic oligonucleotide
gctcttactcccatcactga

SEQ ID NO: 2404 - DNA, 18 bp, Artificial sequence
  Synthetic oligonucleotide
ctcttactcccatcactg

SEQ ID NO: 2405 - DNA, 19 bp, Artificial sequence
  Synthetic oligonucleotide
gctcttactcccatcactg

SEQ ID NO: 2406 - DNA, 20 bp, Artificial sequence
  Synthetic oligonucleotide
tgctcttactcccatcactg

SEQ ID NO: 2407 - DNA, 19 bp, Artificial sequence
  Synthetic oligonucleotide
tgctcttactcccatcact

SEQ ID NO: 2408 - DNA, 20 bp, Artificial sequence
  Synthetic oligonucleotide
ttgctcttactcccatcact

SEQ ID NO: 2409 - DNA, 19 bp, Artificial sequence
  Synthetic oligonucleotide
ttgctcttactcccatcac

SEQ ID NO: 2410 - DNA, 20 bp, Artificial sequence
  Synthetic oligonucleotide
tttgctcttactcccatcac

SEQ ID NO: 2411 - DNA, 19 bp, Artificial sequence
  Synthetic oligonucleotide
tttgctcttactcccatca

SEQ ID NO: 2412 - DNA, 20 bp, Artificial sequence
  Synthetic oligonucleotide
atttgctcttactcccatca

SEQ ID NO: 2413 - DNA, 19 bp, Artificial sequence
  Synthetic oligonucleotide
atttgctcttactcccatc

SEQ ID NO: 2414 - DNA, 20 bp, Artificial sequence
  Synthetic oligonucleotide
aatttgctcttactcccatc

SEQ ID NO: 2415 - DNA, 19 bp, Artificial sequence
  Synthetic oligonucleotide
aatttgctcttactcccat

SEQ ID NO: 2416 - DNA, 20 bp, Artificial sequence
  Synthetic oligonucleotide
aaatttgctcttactcccat

SEQ ID NO: 2417 - DNA, 19 bp, Artificial sequence
  Synthetic oligonucleotide
aaatttgctcttactccca

SEQ ID NO: 2418 - DNA, 20 bp, Artificial sequence
  Synthetic oligonucleotide
gaaatttgctcttactccca

SEQ ID NO: 2419 - DNA, 20 bp, Artificial sequence
  Synthetic oligonucleotide
cgagccaaagccgagtgaca

SEQ ID NO: 2420 - DNA, 18 bp, Artificial sequence
  Synthetic oligonucleotide
gagccaaagccgagtgac

SEQ ID NO: 2421 - DNA, 19 bp, Artificial sequence
  Synthetic oligonucleotide
cgagccaaagccgagtgac

SEQ ID NO: 2422 - DNA, 20 bp, Artificial sequence
  Synthetic oligonucleotide
ccgagccaaagccgagtgac

SEQ ID NO: 2423 - DNA, 18 bp, Artificial sequence
  Synthetic oligonucleotide
cgagccaaagccgagtga

SEQ ID NO: 2424 - DNA, 19 bp, Artificial sequence
  Synthetic oligonucleotide
ccgagccaaagccgagtga

SEQ ID NO: 2425 - DNA, 20 bp, Artificial sequence
  Synthetic oligonucleotide
cccgagccaaagccgagtga

SEQ ID NO: 2426 - DNA, 19 bp, Artificial sequence
  Synthetic oligonucleotide
cccgagccaaagccgagtg

SEQ ID NO: 2427 - DNA, 20 bp, Artificial sequence
  Synthetic oligonucleotide
tcccgagccaaagccgagtg

SEQ ID NO: 2428 - DNA, 18 bp, Artificial sequence
  Synthetic oligonucleotide
cccgagccaaagccgagt

SEQ ID NO: 2429 - DNA, 19 bp, Artificial sequence
  Synthetic oligonucleotide
tcccgagccaaagccgagt

SEQ ID NO: 2430 - DNA, 20 bp, Artificial sequence
  Synthetic oligonucleotide
gtcccgagccaaagccgagt

SEQ ID NO: 2431 - DNA, 18 bp, Artificial sequence
  Synthetic oligonucleotide
tcccgagccaaagccgag

SEQ ID NO: 2432 - DNA, 19 bp, Artificial sequence
  Synthetic oligonucleotide
gtcccgagccaaagccgag

SEQ ID NO: 2433 - DNA, 20 bp, Artificial sequence
  Synthetic oligonucleotide
agtcccgagccaaagccgag

SEQ ID NO: 2434 - DNA, 19 bp, Artificial sequence
  Synthetic oligonucleotide
agtcccgagccaaagccga

SEQ ID NO: 2435 - DNA, 20 bp, Artificial sequence
  Synthetic oligonucleotide
aagtcccgagccaaagccga

SEQ ID NO: 2436 - DNA, 18 bp, Artificial sequence
  Synthetic oligonucleotide
agtcccgagccaaagccg

SEQ ID NO: 2437 - DNA, 19 bp, Artificial sequence
  Synthetic oligonucleotide
aagtcccgagccaaagccg

SEQ ID NO: 2438 - DNA, 20 bp, Artificial sequence
  Synthetic oligonucleotide
gaagtcccgagccaaagccg

SEQ ID NO: 2439 - DNA, 18 bp, Artificial sequence
  Synthetic oligonucleotide
aagtcccgagccaaagcc

SEQ ID NO: 2440 - DNA, 19 bp, Artificial sequence
  Synthetic oligonucleotide
gaagtcccgagccaaagcc

SEQ ID NO: 2441 - DNA, 20 bp, Artificial sequence
  Synthetic oligonucleotide
tgaagtcccgagccaaagcc

SEQ ID NO: 2442 - DNA, 19 bp, Artificial sequence
  Synthetic oligonucleotide
tgaagtcccgagccaaagc

SEQ ID NO: 2443 - DNA, 20 bp, Artificial sequence
  Synthetic oligonucleotide
ttgaagtcccgagccaaagc

SEQ ID NO: 2444 - DNA, 18 bp, Artificial sequence
  Synthetic oligonucleotide
acatccaaataacaatat

SEQ ID NO: 2445 - DNA, 18 bp, Artificial sequence
  Synthetic oligonucleotide
tcctgtctcaaacaccta

SEQ ID NO: 2446 - DNA, 18 bp, Artificial sequence
  Synthetic oligonucleotide
agcttatcacagtaggtg

SEQ ID NO: 2447 - DNA, 18 bp, Artificial sequence
  Synthetic oligonucleotide
cctttgcttcacacacca

SEQ ID NO: 2448 - DNA, 18 bp, Artificial sequence
  Synthetic oligonucleotide
tggttctacaacctgccc

SEQ ID NO: 2449 - DNA, 18 bp, Artificial sequence
  Synthetic oligonucleotide
cctttgtaaccttggaac

SEQ ID NO: 2450 - DNA, 18 bp, Artificial sequence
  Synthetic oligonucleotide
agttaaaagatggcaacc

SEQ ID NO: 2451 - DNA, 18 bp, Artificial sequence
  Synthetic oligonucleotide
ctgggcattttgataaaa

SEQ ID NO: 2452 - DNA, 18 bp, Artificial sequence
  Synthetic oligonucleotide
agtgccagacattttcaa

SEQ ID NO: 2453 - DNA, 18 bp, Artificial sequence
  Synthetic oligonucleotide
ctggcacaacaggcattg

SEQ ID NO: 2454 - DNA, 18 bp, Artificial sequence
  Synthetic oligonucleotide
gtggtacagaggctgtgt

SEQ ID NO: 2455 - DNA, 18 bp, Artificial sequence
  Synthetic oligonucleotide
ttgcagattctgaatacc

SEQ ID NO: 2456 - DNA, 18 bp, Artificial sequence
  Synthetic oligonucleotide
tatgattcccaggagtct

SEQ ID NO: 2457 - DNA, 18 bp, Artificial sequence
  Synthetic oligonucleotide
gtgacccttcagggcaat

SEQ ID NO: 2458 - DNA, 18 bp, Artificial sequence
  Synthetic oligonucleotide
atgcaggtgccttgcagg

SEQ ID NO: 2459 - DNA, 18 bp, Artificial sequence
  Synthetic oligonucleotide
cctgctgccaacagtaga

SEQ ID NO: 2460 - DNA, 18 bp, Artificial sequence
  Synthetic oligonucleotide
ccctcacgggctgttgtg

SEQ ID NO: 2461 - DNA, 18 bp, Artificial sequence
  Synthetic oligonucleotide
acggtctgagcatgaggc

SEQ ID NO: 2462 - DNA, 18 bp, Artificial sequence
  Synthetic oligonucleotide
agccatggacctgctctg

SEQ ID NO: 2463 - DNA, 18 bp, Artificial sequence
  Synthetic oligonucleotide
gacagtataccccacatc

SEQ ID NO: 2464 - DNA, 18 bp, Artificial sequence
  Synthetic oligonucleotide
aagagtggtaaaacctac

SEQ ID NO: 2465 - DNA, 18 bp, Artificial sequence
  Synthetic oligonucleotide
gctcaccagcaggaactt

SEQ ID NO: 2466 - DNA, 18 bp, Artificial sequence
  Synthetic oligonucleotide
aagggcccagtgtagcac

SEQ ID NO: 2467 - DNA, 18 bp, Artificial sequence
  Synthetic oligonucleotide
ccaataagtggcagtgat

SEQ ID NO: 2468 - DNA, 18 bp, Artificial sequence
  Synthetic oligonucleotide
accatgcctggcagatga

SEQ ID NO: 2469 - DNA, 18 bp, Artificial sequence
  Synthetic oligonucleotide
cttagtcatcttccctca

SEQ ID NO: 2470 - DNA, 18 bp, Artificial sequence
  Synthetic oligonucleotide
atttctgaattctttgcc

SEQ ID NO: 2471 - DNA, 18 bp, Artificial sequence
  Synthetic oligonucleotide
cttacactctggaaggtt

SEQ ID NO: 2472 - DNA, 18 bp, Artificial sequence
  Synthetic oligonucleotide
tatccagggctgagcagg

SEQ ID NO: 2473 - DNA, 18 bp, Artificial sequence
  Synthetic oligonucleotide
ggagtcaatctgccctgg

SEQ ID NO: 2474 - DNA, 18 bp, Artificial sequence
  Synthetic oligonucleotide
cttccctgtggcactttg

SEQ ID NO: 2475 - DNA, 18 bp, Artificial sequence
  Synthetic oligonucleotide
atgcctcactcaacaagg

SEQ ID NO: 2476 - DNA, 18 bp, Artificial sequence
  Synthetic oligonucleotide
ctccactttgggaccagg

SEQ ID NO: 2477 - DNA, 18 bp, Artificial sequence
  Synthetic oligonucleotide
ggcacagcacccacatgc

SEQ ID NO: 2478 - DNA, 18 bp, Artificial sequence
  Synthetic oligonucleotide
tgaagtcccgagccaaag

SEQ ID NO: 2479 - DNA, 18 bp, Artificial sequence
  Synthetic oligonucleotide
ttgaagtcccgagccaaa

SEQ ID NO: 2480 - DNA, 18 bp, Artificial sequence
  Synthetic oligonucleotide
ttttgaagtcccgagcca

SEQ ID NO: 2481 - DNA, 18 bp, Artificial sequence
  Synthetic oligonucleotide
attttgaagtcccgagcc

SEQ ID NO: 2482 - DNA, 18 bp, Artificial sequence
  Synthetic oligonucleotide
tgattttgaagtcccgag

SEQ ID NO: 2483 - DNA, 18 bp, Artificial sequence
  Synthetic oligonucleotide
ctgattttgaagtcccga

SEQ ID NO: 2484 - DNA, 19 bp, Artificial sequence
  Synthetic oligonucleotide
tgatcttccatcacttcga

SEQ ID NO: 2485 - DNA, 19 bp, Artificial sequence
  Synthetic oligonucleotide
gttttcaaacacaccttca

SEQ ID NO: 2486 - DNA, 19 bp, Artificial sequence
  Synthetic oligonucleotide
ttttcttaccaccctaaca

SEQ ID NO: 2487 - DNA, 19 bp, Artificial sequence
  Synthetic oligonucleotide
cgttttcttaccaccctaa

SEQ ID NO: 2488 - DNA, 19 bp, Artificial sequence
  Synthetic oligonucleotide
aaaccgttttcttaccacc

SEQ ID NO: 2489 - DNA, 19 bp, Artificial sequence
  Synthetic oligonucleotide
aaaaaccgttttcttacca

SEQ ID NO: 2490 - DNA, 19 bp, Artificial sequence
  Synthetic oligonucleotide
agctcatcaaagcaaaaac

SEQ ID NO: 2491 - DNA, 19 bp, Artificial sequence
  Synthetic oligonucleotide
tcaaaagactatgtatttt

SEQ ID NO: 2492 - DNA, 19 bp, Artificial sequence
  Synthetic oligonucleotide
tgtaaataattgccaagtg

SEQ ID NO: 2493 - DNA, 19 bp, Artificial sequence
  Synthetic oligonucleotide
taagccaccatgcctgtaa

SEQ ID NO: 2494 - DNA, 19 bp, Artificial sequence
  Synthetic oligonucleotide
tggacccgcctacttgctc

SEQ ID NO: 2495 - DNA, 19 bp, Artificial sequence
  Synthetic oligonucleotide
tttcgatgagtgacatgcg

SEQ ID NO: 2496 - DNA, 19 bp, Artificial sequence
  Synthetic oligonucleotide
tgcttgctcgcaaggacgc

SEQ ID NO: 2497 - DNA, 19 bp, Artificial sequence
  Synthetic oligonucleotide
cgcctgcttgctcgcaagg

SEQ ID NO: 2498 - DNA, 19 bp, Artificial sequence
  Synthetic oligonucleotide
cccgcctgcttgctcgcaa

SEQ ID NO: 2499 - DNA, 19 bp, Artificial sequence
  Synthetic oligonucleotide
gacccgcctgcttgctcgc

SEQ ID NO: 2500 - DNA, 19 bp, Artificial sequence
  Synthetic oligonucleotide
tggacccgcctgcttgctc

SEQ ID NO: 2501 - DNA, 19 bp, Artificial sequence
  Synthetic oligonucleotide
cctggacccgcctgcttgc

SEQ ID NO: 2502 - DNA, 19 bp, Artificial sequence
  Synthetic oligonucleotide
accctggacccgcctgctt

SEQ ID NO: 2503 - DNA, 19 bp, Artificial sequence
  Synthetic oligonucleotide
agtgacacgccaccctgga

SEQ ID NO: 2504 - DNA, 19 bp, Artificial sequence
  Synthetic oligonucleotide
cctttggtagccagaaaaa

SEQ ID NO: 2505 - DNA, 19 bp, Artificial sequence
  Synthetic oligonucleotide
tctgcacctttggtagcca

SEQ ID NO: 2506 - DNA, 19 bp, Artificial sequence
  Synthetic oligonucleotide
acagcacggcgcatgggac

SEQ ID NO: 2507 - DNA, 19 bp, Artificial sequence
  Synthetic oligonucleotide
ccacagcacggcgcatggg

SEQ ID NO: 2508 - DNA, 19 bp, Artificial sequence
  Synthetic oligonucleotide
agccacagcacggcgcatg

SEQ ID NO: 2509 - DNA, 20 bp, Artificial sequence
  Synthetic oligonucleotide
ggtttgttttttaaacaatt

SEQ ID NO: 2510 - DNA, 20 bp, Artificial sequence
  Synthetic oligonucleotide
gaacccaatgagagtagcaa

SEQ ID NO: 2511 - DNA, 20 bp, Artificial sequence
  Synthetic oligonucleotide
ttgccaaaatcaggaatggg

SEQ ID NO: 2512 - DNA, 20 bp, Artificial sequence
  Synthetic oligonucleotide
tcagggcaatctggaagcat

SEQ ID NO: 2513 - DNA, 20 bp, Artificial sequence
  Synthetic oligonucleotide
actctccactccatgtcaat

SEQ ID NO: 2514 - DNA, 20 bp, Artificial sequence
  Synthetic oligonucleotide
cagagctcacagcaatgatc

SEQ ID NO: 2515 - DNA, 20 bp, Artificial sequence
  Synthetic oligonucleotide
tcagcatgagttgtgccaag

SEQ ID NO: 2516 - DNA, 20 bp, Artificial sequence
  Synthetic oligonucleotide
ccagaggaactgtgtgcatt

SEQ ID NO: 2517 - DNA, 20 bp, Artificial sequence
  Synthetic oligonucleotide
ccaagttccctgaggacatt

SEQ ID NO: 2518 - DNA, 20 bp, Artificial sequence
  Synthetic oligonucleotide
gttgtgttttctggtttatt

SEQ ID NO: 2519 - DNA, 20 bp, Artificial sequence
  Synthetic oligonucleotide
tttttttttaagttaggagt

SEQ ID NO: 2520 - DNA, 20 bp, Artificial sequence
  Synthetic oligonucleotide
ttttactggttgtgttttct

SEQ ID NO: 2521 - DNA, 20 bp, Artificial sequence
  Synthetic oligonucleotide
cagctcttaatgctgttata

SEQ ID NO: 2522 - DNA, 20 bp, Artificial sequence
  Synthetic oligonucleotide
ttcagctcctgcacccagca

SEQ ID NO: 2523 - DNA, 20 bp, Artificial sequence
  Synthetic oligonucleotide
ttttgcttttgctctgaaga

SEQ ID NO: 2524 - DNA, 20 bp, Artificial sequence
  Synthetic oligonucleotide
ttgctattaaatataatgta

SEQ ID NO: 2525 - DNA, 20 bp, Artificial sequence
  Synthetic oligonucleotide
gctttttaaagtgacaactg

SEQ ID NO: 2526 - DNA, 20 bp, Artificial sequence
  Synthetic oligonucleotide
ttccacataaatgttctaca

SEQ ID NO: 2527 - DNA, 20 bp, Artificial sequence
  Synthetic oligonucleotide
ccctgattgaggagaggcaa

SEQ ID NO: 2528 - DNA, 20 bp, Artificial sequence
  Synthetic oligonucleotide
atgtttttttctggccgggc

SEQ ID NO: 2529 - DNA, 20 bp, Artificial sequence
  Synthetic oligonucleotide
ttcagtatctgccacatact

SEQ ID NO: 2530 - DNA, 20 bp, Artificial sequence
  Synthetic oligonucleotide
tgaatcaaaggacattaagc

SEQ ID NO: 2531 - DNA, 18 bp, Artificial sequence
  Synthetic oligonucleotide
ggtgataaaagttcacta

SEQ ID NO: 2532 - DNA, 19 bp, Artificial sequence
  Synthetic oligonucleotide
ttgaagtcccgagccaaag

SEQ ID NO: 2533 - DNA, 20 bp, Artificial sequence
  Synthetic oligonucleotide
tttgaagtcccgagccaaag

SEQ ID NO: 2534 - DNA, 19 bp, Artificial sequence
  Synthetic oligonucleotide
tttgaagtcccgagccaaa

SEQ ID NO: 2535 - DNA, 20 bp, Artificial sequence
  Synthetic oligonucleotide
ttttgaagtcccgagccaaa

SEQ ID NO: 2536 - DNA, 19 bp, Artificial sequence
  Synthetic oligonucleotide
ttttgaagtcccgagccaa

SEQ ID NO: 2537 - DNA, 20 bp, Artificial sequence
  Synthetic oligonucleotide
attttgaagtcccgagccaa

SEQ ID NO: 2538 - DNA, 18 bp, Artificial sequence
  Synthetic oligonucleotide
tttgaagtcccgagccaa

SEQ ID NO: 2539 - DNA, 19 bp, Artificial sequence
  Synthetic oligonucleotide
attttgaagtcccgagcca

SEQ ID NO: 2540 - DNA, 20 bp, Artificial sequence
  Synthetic oligonucleotide
gattttgaagtcccgagcca

SEQ ID NO: 2541 - DNA, 19 bp, Artificial sequence
  Synthetic oligonucleotide
gattttgaagtcccgagcc

SEQ ID NO: 2542 - DNA, 19 bp, Artificial sequence
  Synthetic oligonucleotide
tgattttgaagtcccgagc

SEQ ID NO: 2543 - DNA, 19 bp, Artificial sequence
  Synthetic oligonucleotide
ctgattttgaagtcccgag

SEQ ID NO: 2544 - DNA, 20 bp, Artificial sequence
  Synthetic oligonucleotide
actgattttgaagtcccgag

SEQ ID NO: 2545 - DNA, 19 bp, Artificial sequence
  Synthetic oligonucleotide
actgattttgaagtcccga

SEQ ID NO: 2546 - DNA, 20 bp, Artificial sequence
  Synthetic oligonucleotide
cactgattttgaagtcccga

SEQ ID NO: 2547 - DNA, 19 bp, Artificial sequence
  Synthetic oligonucleotide
cactgattttgaagtcccg

SEQ ID NO: 2548 - DNA, 20 bp, Artificial sequence
  Synthetic oligonucleotide
tcactgattttgaagtcccg

SEQ ID NO: 2549 - DNA, 18 bp, Artificial sequence
  Synthetic oligonucleotide
actgattttgaagtcccg

SEQ ID NO: 2550 - DNA, 19 bp, Artificial sequence
  Synthetic oligonucleotide
ttgaagtcccgagccaaag

SEQ ID NO: 2551 - DNA, 19 bp, Artificial sequence
  Synthetic oligonucleotide
tttgaagtcccgagccaaa

SEQ ID NO: 2552 - DNA, 19 bp, Artificial sequence
  Synthetic oligonucleotide
ttttgaagtcccgagccaa

SEQ ID NO: 2553 - DNA, 19 bp, Artificial sequence
  Synthetic oligonucleotide
attttgaagtcccgagcca

SEQ ID NO: 2554 - DNA, 19 bp, Artificial sequence
  Synthetic oligonucleotide
gattttgaagtcccgagcc

SEQ ID NO: 2555 - DNA, 19 bp, Artificial sequence
  Synthetic oligonucleotide
tgattttgaagtcccgagc

SEQ ID NO: 2556 - DNA, 19 bp, Artificial sequence
  Synthetic oligonucleotide
ctgattttgaagtcccgag

SEQ ID NO: 2557 - DNA, 19 bp, Artificial sequence
  Synthetic oligonucleotide
actgattttgaagtcccga

SEQ ID NO: 2558 - DNA, 19 bp, Artificial sequence
  Synthetic oligonucleotide
cactgattttgaagtcccg

SEQ ID NO: 2559 - DNA, 20 bp, Artificial sequence
  Synthetic oligonucleotide
tttgaagtcccgagccaaag

SEQ ID NO: 2560 - DNA, 20 bp, Artificial sequence
  Synthetic oligonucleotide
ttttgaagtcccgagccaaa

SEQ ID NO: 2561 - DNA, 20 bp, Artificial sequence
  Synthetic oligonucleotide
attttgaagtcccgagccaa

SEQ ID NO: 2562 - DNA, 20 bp, Artificial sequence
  Synthetic oligonucleotide
gattttgaagtcccgagcca

SEQ ID NO: 2563 - DNA, 20 bp, Artificial sequence
  Synthetic oligonucleotide
actgattttgaagtcccgag

SEQ ID NO: 2564 - DNA, 20 bp, Artificial sequence
  Synthetic oligonucleotide
cactgattttgaagtcccga

SEQ ID NO: 2565 - DNA, 20 bp, Artificial sequence
  Synthetic oligonucleotide
tcactgattttgaagtcccg

SEQ ID NO: 2566 - DNA, 20 bp, Artificial sequence
  Synthetic oligonucleotide
ttcttatttttagcattaaa

SEQ ID NO: 2567 - DNA, 20 bp, Artificial sequence
  Synthetic oligonucleotide
tttcttatttttagcattaa

SEQ ID NO: 2568 - DNA, 20 bp, Artificial sequence
  Synthetic oligonucleotide
ttttcttatttttagcatta

SEQ ID NO: 2569 - DNA, 20 bp, Artificial sequence
  Synthetic oligonucleotide
tgttttcttatttttagcat

SEQ ID NO: 2570 - DNA, 20 bp, Artificial sequence
  Synthetic oligonucleotide
gtgttttcttatttttagca

SEQ ID NO: 2571 - DNA, 20 bp, Artificial sequence
  Synthetic oligonucleotide
ggtgttttcttatttttagc

SEQ ID NO: 2572 - DNA, 20 bp, Artificial sequence
  Synthetic oligonucleotide
ttggttttcaaacacacctt

SEQ ID NO: 2573 - DNA, 20 bp, Artificial sequence
  Synthetic oligonucleotide
tttggttttcaaacacacct

SEQ ID NO: 2574 - DNA, 18 bp, Artificial sequence
  Synthetic oligonucleotide
cctcatgggcagaggcag

SEQ ID NO: 2575 - DNA, 18 bp, Artificial sequence
  Synthetic oligonucleotide
cgttttcttaccacccta

SEQ ID NO: 2576 - DNA, 18 bp, Artificial sequence
  Synthetic oligonucleotide
accgttttcttaccaccc

SEQ ID NO: 2577 - DNA, 20 bp, Artificial sequence
  Synthetic oligonucleotide
attatcctttgagccacact

SEQ ID NO: 2578 - DNA, 20 bp, Artificial sequence
  Synthetic oligonucleotide
tattatcctttgagccacac

SEQ ID NO: 2579 - DNA, 20 bp, Artificial sequence
  Synthetic oligonucleotide
atattatcctttgagccaca

SEQ ID NO: 2580 - DNA, 20 bp, Artificial sequence
  Synthetic oligonucleotide
tgatattatcctttgagcca

SEQ ID NO: 2581 - DNA, 20 bp, Artificial sequence
  Synthetic oligonucleotide
ttgatattatcctttgagcc

SEQ ID NO: 2582 - DNA, 20 bp, Artificial sequence
  Synthetic oligonucleotide
tttgatattatcctttgagc

SEQ ID NO: 2583 - DNA, 18 bp, Artificial sequence
  Synthetic oligonucleotide
ggaggcctgtggcctcca

SEQ ID NO: 2584 - DNA, 18 bp, Artificial sequence
  Synthetic oligonucleotide
gaggaggcctgtggcctc

What is claimed is:

1. A compound comprising a modified oligonucleotide consisting of 12 to 50 linked nucleosides and having a nucleobase sequence comprising at least 8 contiguous nucleobases of a sequence selected from among SEQ ID Nos: 1699, 1700, 1701, 1702, and 1703, wherein the nucleobase sequence of the modified oligonucleotide is at least 90% complementary to SEQ ID NO: 1.

2. The compound of claim 1, wherein at least one internucleoside linkage of the modified oligonucleotide is a modified internucleoside linkage.

3. The compound of claim 2, wherein the modified oligonucleotide is a single-stranded oligonucleotide.

4. The compound of claim 2, wherein the modified internucleoside linkage is a phosphorothioate internucleoside linkage.

5. The compound of claim 4, wherein at least one internucleoside linkage of the modified oligonucleotide is a phosphodiester internucleoside linkage.

6. The compound of claim 2, wherein at least one nucleobase of the modified oligonucleotide is a modified nucleobase.

7. The compound of claim 6, wherein the modified nucleobase is a 5-methylcytosine.

8. The compound of claim 1, wherein at least one nucleoside of the modified oligonucleotide comprises a modified sugar.

9. The compound of claim 8, wherein at least one modified sugar is a bicyclic sugar.

10. The compound of claim 9, wherein each bicyclic sugar comprises a chemical bridge between the 4' and 2' positions of the sugar, wherein each chemical bridge is independently selected from: 4'-CH(R)—O-2' and 4'-(CH$_2$)$_2$—O-2', wherein each R is independently selected from H, C$_1$-C$_6$ alkyl, and C$_1$-C$_6$ alkoxy.

11. The compound of claim 10, wherein at least one chemical bridge is 4'-CH(R)—O-2' and wherein R is methyl.

12. The compound of claim 10, wherein at least one chemical bridge is 4'-CH(R)—O-2' and wherein R is H.

13. The compound of claim 10, wherein at least one chemical bridge is 4'-CH(R)—O-2' and wherein R is —CH$_2$—O—CH$_3$.

14. The compound of claim 7, wherein at least one modified sugar comprises a 2'-O-methoxyethyl group or a 2'-O-methyl group.

15. The compound of claim 1, wherein the at least one nucleoside of the modified oligonucleotide comprises a sugar surrogate.

16. The compound of claim 15, wherein the at least one sugar surrogate is a morpholino or a peptide nucleic acid.

17. The compound of claim 1, wherein the modified oligonucleotide comprises:
a 5' wing segment having from 1 to 6 nucleosides and wherein each nucleoside of the 5' wing segment comprises a modified sugar;
a 3' wing segment having from 1 to 6 nucleosides and wherein each nucleoside of the 3' wing segment comprises a modified sugar; and
a gap segment having from 8 to 15 nucleosides and wherein each nucleoside of the gap segment is a deoxynucleoside.

18. The compound of claim 1, wherein the compound comprises a conjugate group.

19. A composition comprising a compound according to claim 1 and a pharmaceutically acceptable carrier or diluent.

20. A compound comprising a modified oligonucleotide consisting of 12 to 50 linked nucleosides and comprising a nucleobase sequence having at least 8 consecutive nucleobases complementary to an equal length portion of nucleobases 139811 to 139836 of SEQ ID NO: 1, wherein the nucleobase sequence of the modified oligonucleotide is at least 90% complementary to SEQ ID NO: 1.

21. The compound of claim 20, wherein the nucleobase sequence has at least 12 consecutive nucleobases selected from among SEQ ID Nos: 1699 -1703.

22. The compound of claim 20, wherein at least one internucleoside linkage of the modified oligonucleotide is a modified internucleoside linkage.

23. The compound of claim 22, wherein the modified oligonucleotide is a single-stranded oligonucleotide.

24. The compound of claim 22, wherein the modified internucleoside linkage is a phosphorothioate internucleoside linkage.

25. The compound of claim 24, wherein at least one internucleoside linkage of the modified oligonucleotide is a phosphodiester internucleoside linkage.

26. The compound of claim 22, wherein at least one nucleobase of the modified oligonucleotide is a modified nucleobase.

27. The compound of claim 26, wherein the modified nucleobase is a 5-methylcytosine.

28. The compound of claim 20, wherein at least one nucleoside of the modified oligonucleotide comprises a modified sugar.

29. The compound of claim 28, wherein at least one modified sugar is a bicyclic sugar.

30. The compound of claim 29, wherein each bicyclic sugar comprises a chemical bridge between the 4' and 2' positions of the sugar, wherein each chemical bridge is independently selected from: 4'-CH(R)—O-2' and 4'-(CH$_2$)$_2$—O-2', wherein each R is independently selected from H, C$_1$-C$_6$ alkyl, and C$_1$-C$_6$ alkoxy.

31. The compound of claim 30, wherein at least one chemical bridge is 4'-CH(R)—O-2' and wherein R is methyl.

32. The compound of claim 30, wherein at least one chemical bridge is 4'-CH(R)—O-2' and wherein R is H.

33. The compound of claim 30, wherein at least one chemical bridge is 4'-CH(R)—O-2' and wherein R is —CH$_2$—O—CH$_3$.

34. The compound of claim 28, wherein at least one modified sugar comprises a 2'-O-methoxyethyl group or a 2'-O-methyl group.

35. The compound of claim 20, wherein the at least one nucleoside of the modified oligonucleotide comprises a sugar surrogate.

36. The compound of claim 35, wherein the at least one sugar surrogate is a morpholino or a peptide nucleic acid.

37. The compound of claim 20, wherein the modified oligonucleotide comprises:
a 5' wing segment having from 1 to 6 nucleosides and wherein each nucleoside of the 5' wing segment comprises a modified sugar;
a 3' wing segment having from 1 to 6 nucleosides and wherein each nucleoside of the 3' wing segment comprises a modified sugar; and
a gap segment having from 8 to 15 nucleosides and wherein each nucleoside of the gap segment is a deoxynucleoside.

38. The compound of claim 20, wherein the compound comprises a conjugate group.

39. A composition comprising a compound according to claim 20 and a pharmaceutically acceptable carrier or diluent.

40. The compound of claim 1, wherein the modified oligonucleotide comprises:
- a 5' wing segment having from 1 to 6 nucleosides and wherein at least 4 nucleosides of the 5' wing segment comprises a modified sugar;
- a 3' wing segment having from 1 to 6 nucleosides and wherein at least 4 nucleosides of the 3' wing segment comprises a modified sugar; and
- a gap segment having from 8 to 15 nucleosides and wherein each nucleoside of the gap segment is a deoxynucleoside.

41. The compound of claim 40, wherein 1 or 2 nucleosides of the 5' wing segment is a deoxynucleoside and 1 or 2 nucleosides of the 3' wing segment is a deoxynucleoside.

42. The compound of claim 41, wherein at least one modified sugar is a bicyclic sugar.

43. The compound of claim 42, wherein each bicyclic sugar comprises a chemical bridge between the 4' and 2' positions of the sugar, wherein each chemical bridge is independently selected from: 4'-CH(R)—O-2' and 4'-(CH$_2$)$_2$—O-2', wherein each R is independently selected from H, C$_1$-C$_6$ alkyl, and C$_1$-C$_6$ alkoxy.

44. The compound of claim 20, wherein the modified oligonucleotide comprises:
- a 5' wing segment having from 1 to 6 nucleosides and wherein at least 4 nucleosides of the 5' wing segment comprises a modified sugar;
- a 3' wing segment having from 1 to 6 nucleosides and wherein at least 4 nucleosides of the 3' wing segment comprises a modified sugar; and
- a gap segment having from 8 to 15 nucleosides and wherein each nucleoside of the gap segment is a deoxynucleoside.

45. The compound of claim 44, wherein 1 or 2 nucleosides of the 5' wing segment is a deoxynucleoside and 1 or 2 nucleosides of the 3' wing segment is a deoxynucleoside.

46. The compound of claim 45, wherein at least one modified sugar is a bicyclic sugar.

47. The compound of claim 46, wherein each bicyclic sugar comprises a chemical bridge between the 4' and 2' positions of the sugar, wherein each chemical bridge is independently selected from: 4'-CH(R)—O-2' and 4'-(CH$_2$)$_2$—O-2', wherein each R is independently selected from H, C$_1$-C$_6$ alkyl, and C$_1$-C$_6$ alkoxy.

* * * * *